United States Patent 12,760,100 (METHODS AND COMPOSITIONS TO IMPROVE THE SAFETY AND EFFICACY OF CELLULAR THERAPIES) - sequence listing, part 5

SEQ ID NO: 10082 - protein, 632 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10083 - protein, 631 aa, Artificial Sequence
  Synthetic Polypeptide
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10084 - protein, 623 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFERAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10085 - protein, 633 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10086 - protein, 624 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10087 - protein, 628 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10088 - protein, 626 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10089 - protein, 626 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10090 - protein, 627 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10091 - protein, 624 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10092 - protein, 627 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10093 - protein, 751 aa, Artificial Sequence
  Synthetic Polypeptide
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10094 - protein, 627 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10095 - protein, 627 aa, Artificial Sequence; identical to SEQ ID NO: 10094
  Synthetic Polypeptide

SEQ ID NO: 10096 - protein, 627 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10097 - protein, 629 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10098 - protein, 630 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10099 - protein, 622 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10100 - protein, 628 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10101 - protein, 621 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10102 - protein, 626 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10103 - protein, 623 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10104 - protein, 633 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10105 - protein, 629 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10106 - protein, 633 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRALEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10107 - protein, 618 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10108 - protein, 627 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10109 - protein, 623 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10110 - protein, 631 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10111 - protein, 626 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10112 - protein, 621 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10113 - protein, 624 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10114 - protein, 619 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10115 - protein, 629 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10116 - protein, 621 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10117 - protein, 624 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10118 - protein, 634 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10119 - protein, 631 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10120 - protein, 623 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10121 - protein, 616 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10122 - protein, 621 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10123 - protein, 624 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10124 - protein, 629 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10125 - protein, 626 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10126 - protein, 624 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10127 - protein, 624 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10128 - protein, 630 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGALEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10129 - protein, 630 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGALEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10130 - protein, 628 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10131 - protein, 623 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10132 - protein, 618 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVELEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10133 - protein, 624 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10134 - protein, 631 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10135 - protein, 632 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10136 - protein, 629 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10137 - protein, 626 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10138 - protein, 627 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10139 - protein, 624 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10140 - protein, 622 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10141 - protein, 624 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10142 - protein, 626 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10143 - protein, 631 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10144 - protein, 625 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10145 - protein, 626 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10146 - protein, 624 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10147 - protein, 623 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10148 - protein, 624 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10149 - protein, 623 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10150 - protein, 624 aa, Artificial Sequence
  Synthetic Polypeptide
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10151 - protein, 631 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10152 - protein, 637 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10153 - protein, 622 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10154 - protein, 632 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEILEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFELEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10155 - protein, 612 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10156 - protein, 758 aa, Artificial Sequence
  Synthetic Polypeptide
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10157 - protein, 622 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10158 - protein, 626 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10159 - protein, 622 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10160 - protein, 623 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10161 - protein, 628 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10162 - protein, 622 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10163 - protein, 623 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10164 - protein, 631 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10165 - protein, 627 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10166 - protein, 624 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10167 - protein, 624 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10168 - protein, 623 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10169 - protein, 623 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10170 - protein, 627 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10171 - protein, 630 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10172 - protein, 632 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10173 - protein, 631 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQILEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10174 - protein, 621 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10175 - protein, 623 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10176 - protein, 625 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10177 - protein, 626 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10178 - protein, 622 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10179 - protein, 641 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10180 - protein, 638 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10181 - protein, 612 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10182 - protein, 628 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10183 - protein, 619 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10184 - protein, 620 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10185 - protein, 620 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10186 - protein, 631 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10187 - protein, 627 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10188 - protein, 622 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10189 - protein, 626 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10190 - protein, 635 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10191 - protein, 626 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10192 - protein, 629 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10193 - protein, 624 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10194 - protein, 625 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10195 - protein, 634 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10196 - protein, 624 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10197 - protein, 621 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10198 - protein, 626 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10199 - protein, 625 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10200 - protein, 627 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10201 - protein, 606 aa, Artificial Sequence
  Synthetic Polypeptide
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10202 - protein, 623 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10203 - protein, 621 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10204 - protein, 632 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10205 - protein, 627 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10206 - protein, 628 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10207 - protein, 627 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVQLVQSGGGVMRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10208 - protein, 640 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10209 - protein, 634 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10210 - protein, 626 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10211 - protein, 625 aa, Artificial Sequence
  Synthetic Polypeptide
MALPVTALLLPLALLLHAARPDEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10212 - protein, 626 aa, Artificial Sequence
  Synthetic Polypeptide
MALPVTALLLPLALLLHAARPDDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10213 - protein, 617 aa, Artificial Sequence
  Synthetic Polypeptide
MALPVTALLLPLALLLHAARPDDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10214 - protein, 620 aa, Artificial Sequence
  Synthetic Polypeptide
MALPVTALLLPLALLLHAARPDDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10215 - protein, 627 aa, Artificial Sequence
  Synthetic Polypeptide
MALPVTALLLPLALLLHAARPDDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10216 - protein, 623 aa, Artificial Sequence
  Synthetic Polypeptide
MALPVTALLLPLALLLHAARPDDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10217 - protein, 623 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10218 - protein, 624 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10219 - protein, 629 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10220 - protein, 625 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10221 - protein, 631 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10222 - protein, 636 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10223 - protein, 636 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFELEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10224 - protein, 626 aa, Artificial Sequence; identical to SEQ ID NO: 10089
  Synthetic Polypeptide

SEQ ID NO: 10225 - protein, 626 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10226 - protein, 630 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10227 - protein, 630 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10228 - protein, 624 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10229 - protein, 626 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10230 - protein, 623 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10231 - protein, 624 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10232 - protein, 620 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10233 - protein, 623 aa, Artificial Sequence
  Synthetic Polypeptide
MALPVTALLLPLALLLHAARPDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10234 - protein, 622 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10235 - protein, 631 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10236 - protein, 635 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10237 - protein, 630 aa, Artificial Sequence
  Synthetic Polypeptide
MALPVTALLLPLALLLHAARPDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10238 - protein, 626 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10239 - protein, 626 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10240 - protein, 629 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10241 - protein, 627 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10242 - protein, 626 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10243 - protein, 628 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10244 - protein, 625 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10245 - protein, 626 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10246 - protein, 627 aa, Artificial Sequence
  Synthetic Polypeptide
MALPVTALLLPLALLLHAARPDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAALEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10247 - protein, 626 aa, Artificial Sequence
  Synthetic Polypeptide
MALPVTALLLPLALLLHAARPDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10248 - protein, 621 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10249 - protein, 626 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10250 - protein, 625 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10251 - protein, 625 aa, Artificial Sequence; identical to SEQ ID NO: 10250
  Synthetic Polypeptide

SEQ ID NO: 10252 - protein, 622 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10253 - protein, 623 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10254 - protein, 624 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10255 - protein, 630 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10256 - protein, 628 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10257 - protein, 628 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10258 - protein, 626 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10259 - protein, 627 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10260 - protein, 627 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10261 - protein, 627 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10262 - protein, 625 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10263 - protein, 625 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10264 - protein, 627 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10265 - protein, 633 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFESVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10266 - protein, 624 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10267 - protein, 626 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10268 - protein, 628 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10269 - protein, 632 aa, Artificial Sequence
  Synthetic Polypeptide
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFELEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10270 - protein, 629 aa, Artificial Sequence
  Synthetic Polypeptide
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10271 - protein, 622 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10272 - protein, 626 aa, Artificial Sequence
  Synthetic Polypeptide
MALPVTALLLPLALLLHAARPQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10273 - protein, 627 aa, Artificial Sequence
  Synthetic Polypeptide
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFESSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10274 - protein, 636 aa, Artificial Sequence
  Synthetic Polypeptide
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10275 - protein, 614 aa, Artificial Sequence
  Synthetic Polypeptide
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10276 - protein, 636 aa, Artificial Sequence
  Synthetic Polypeptide
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10277 - protein, 635 aa, Artificial Sequence
  Synthetic Polypeptide
MALPVTALLLPLALLLHAARPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10278 - protein, 635 aa, Artificial Sequence
  Synthetic Polypeptide
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10279 - protein, 631 aa, Artificial Sequence
  Synthetic Polypeptide
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10280 - protein, 616 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10281 - protein, 635 aa, Artificial Sequence
  Synthetic Polypeptide
MALPVTALLLPLALLLHAARPLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10282 - protein, 625 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10283 - protein, 628 aa, Artificial Sequence
  Synthetic Polypeptide
MALPVTALLLPLALLLHAARPNFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10284 - protein, 620 aa, Artificial Sequence
  Synthetic Polypeptide
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10285 - protein, 628 aa, Artificial Sequence
  Synthetic Polypeptide
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10286 - protein, 626 aa, Artificial Sequence
  Synthetic Polypeptide
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10287 - protein, 625 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10288 - protein, 628 aa, Artificial Sequence
  Synthetic Polypeptide
MALPVTALLLPLALLLHAARPELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10289 - protein, 622 aa, Artificial Sequence
  Synthetic Polypeptide
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10290 - protein, 629 aa, Artificial Sequence
  Synthetic Polypeptide
MALPVTALLLPLALLLHAARPDVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVILVESGGGLVKPGGSLKLSCAASGFTFSSYTMSWVRQTPEKRLEWVATISSGGGNTYYPDSVKGRFTISRDNAKNNLYLQMSSLRSEDTALYYCARYYRYEAWFASWGQGTLVTVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10291 - protein, 626 aa, Artificial Sequence; identical to SEQ ID NO: 10225
  Synthetic Polypeptide

SEQ ID NO: 10292 - protein, 627 aa, Artificial Sequence
  Synthetic Polypeptide
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10293 - protein, 625 aa, Artificial Sequence
  Synthetic Polypeptide
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10294 - protein, 626 aa, Artificial Sequence
  Synthetic Polypeptide
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10295 - protein, 622 aa, Artificial Sequence
  Synthetic Polypeptide
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10296 - protein, 624 aa, Artificial Sequence
  Synthetic Polypeptide
MALPVTALLLPLALLLHAARPDVVMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSQTLSLTCTVSGVSLPDYGVSWIRQPPGKGLEWIGVIWGSETTYYNSALKSRVLISVDTSKNQVSLKLSSVTAADTAVYYCARHYYYGGSYAMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10297 - protein, 626 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKALEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10298 - protein, 637 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10299 - protein, 630 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10300 - protein, 622 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10301 - protein, 629 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10302 - protein, 622 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10303 - protein, 630 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10304 - protein, 602 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRASRSRTLILPCTSCGIARAATRACVCSPTSTARPTCPRARTPTCTSPISACWTCGAWTSRATPPWPGPTSPISPAPTPSTTALSPRTHSSQAPRAAATSWWKRASRQTPTTSRTASASESCCKWPCLPCPCGCGPAAPREADLASRPISTCSWLATWNPTQALLVWTGFGASFSLSALLPARIPSNRSSWWNQGAVWCSRVGADCHAWRLASHSRTTACTGCDRPPERVWSGSPSGTTDLMSITEILREGSPSPATIAKICSTCKTHSGRMIRRSTIALAQGLLWPAHSITGDRVPWQYQARVRTRTCSHLRWPCSSLARPRSATPRKPPSCAWLPASTPTMWNCLGGSTAKRCTAACVPTPSHKNSPPTTAGTAAADECPPPSGRTPGTTSDARCSSTAARTTSGPRTEPSPPRSCLPKPGAEPIAALPARATSRACAPPSCTRSCWARPPCTPCWCLPWCWLWSSGRTAG

SEQ ID NO: 10305 - protein, 632 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10306 - protein, 622 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWRYALDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10307 - protein, 622 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10308 - protein, 627 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10309 - protein, 632 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10310 - protein, 637 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10311 - protein, 628 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10312 - protein, 624 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10313 - protein, 625 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10314 - protein, 627 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10315 - protein, 629 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10316 - protein, 625 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10317 - protein, 622 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10318 - protein, 623 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10319 - protein, 629 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10320 - protein, 619 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10321 - protein, 619 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10322 - skipped

SEQ ID NO: 10323 - protein, 622 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10324 - protein, 623 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10325 - protein, 624 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10326 - protein, 631 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10327 - protein, 630 aa, Artificial Sequence
  Synthetic Polypeptide
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10328 - protein, 622 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFERAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10329 - protein, 632 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10330 - protein, 623 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10331 - protein, 627 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10332 - protein, 625 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10333 - protein, 625 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10334 - protein, 626 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10335 - protein, 623 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10336 - protein, 626 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10337 - protein, 750 aa, Artificial Sequence
  Synthetic Polypeptide
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10338 - protein, 626 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10339 - protein, 626 aa, Artificial Sequence; identical to SEQ ID NO: 10338
  Synthetic Polypeptide

SEQ ID NO: 10340 - protein, 626 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10341 - protein, 628 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10342 - protein, 629 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10343 - protein, 621 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10344 - protein, 627 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10345 - protein, 620 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10346 - protein, 625 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10347 - protein, 622 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10348 - protein, 632 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10349 - protein, 628 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10350 - protein, 632 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10351 - protein, 617 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10352 - protein, 626 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10353 - protein, 622 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10354 - protein, 630 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10355 - protein, 625 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10356 - protein, 620 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10357 - protein, 623 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10358 - protein, 618 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10359 - protein, 628 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10360 - protein, 620 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10361 - protein, 623 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10362 - protein, 633 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10363 - protein, 630 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10364 - protein, 622 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10365 - protein, 615 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10366 - protein, 620 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10367 - protein, 623 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10368 - protein, 628 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10369 - protein, 625 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10370 - protein, 623 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10371 - protein, 623 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10372 - protein, 629 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10373 - protein, 629 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10374 - protein, 627 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10375 - protein, 622 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10376 - protein, 617 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVELGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10377 - protein, 623 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10378 - protein, 630 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10379 - protein, 631 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10380 - protein, 628 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10381 - protein, 625 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10382 - protein, 626 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10383 - protein, 623 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10384 - protein, 621 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10385 - protein, 623 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10386 - protein, 625 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10387 - protein, 630 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10388 - protein, 624 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10389 - protein, 625 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10390 - protein, 623 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10391 - protein, 622 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10392 - protein, 623 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10393 - protein, 622 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10394 - protein, 623 aa, Artificial Sequence
  Synthetic Polypeptide
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10395 - protein, 630 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10396 - protein, 636 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10397 - protein, 621 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10398 - protein, 631 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEILGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10399 - protein, 611 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10400 - protein, 757 aa, Artificial Sequence
  Synthetic Polypeptide
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10401 - protein, 621 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10402 - protein, 625 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10403 - protein, 621 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10404 - protein, 622 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10405 - protein, 627 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10406 - protein, 621 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10407 - protein, 622 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10408 - protein, 630 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10409 - protein, 626 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10410 - protein, 623 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10411 - protein, 623 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10412 - protein, 622 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10413 - protein, 622 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10414 - protein, 626 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10415 - protein, 629 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10416 - protein, 631 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10417 - protein, 630 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQILGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10418 - protein, 620 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10419 - protein, 622 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10420 - protein, 624 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10421 - protein, 625 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10422 - protein, 621 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10423 - protein, 640 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10424 - protein, 637 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10425 - protein, 611 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10426 - protein, 627 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10427 - protein, 618 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10428 - protein, 619 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10429 - protein, 619 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10430 - protein, 630 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10431 - protein, 626 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10432 - protein, 621 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10433 - protein, 625 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10434 - protein, 634 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10435 - protein, 625 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10436 - protein, 628 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10437 - protein, 623 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10438 - protein, 624 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10439 - protein, 633 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10440 - protein, 623 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10441 - protein, 620 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10442 - protein, 625 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10443 - protein, 624 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10444 - protein, 626 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10445 - protein, 605 aa, Artificial Sequence
  Synthetic Polypeptide
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10446 - protein, 622 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10447 - protein, 620 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10448 - protein, 631 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10449 - protein, 626 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10450 - protein, 627 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10451 - protein, 626 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVQSGGGVMRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10452 - protein, 639 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10453 - protein, 633 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10454 - protein, 624 aa, Artificial Sequence
  Synthetic Polypeptide
MALPVTALLLPLALLLHAARPIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10455 - protein, 623 aa, Artificial Sequence
  Synthetic Polypeptide
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10456 - protein, 624 aa, Artificial Sequence
  Synthetic Polypeptide
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10457 - protein, 615 aa, Artificial Sequence
  Synthetic Polypeptide
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10458 - protein, 618 aa, Artificial Sequence
  Synthetic Polypeptide
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10459 - protein, 625 aa, Artificial Sequence
  Synthetic Polypeptide
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10460 - protein, 621 aa, Artificial Sequence
  Synthetic Polypeptide
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10461 - protein, 622 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10462 - protein, 623 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10463 - protein, 628 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10464 - protein, 624 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10465 - protein, 630 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10466 - protein, 635 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10467 - protein, 635 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10468 - protein, 624 aa, Artificial Sequence
  Synthetic Polypeptide
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10469 - protein, 625 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10470 - protein, 629 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10471 - protein, 629 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10472 - protein, 623 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10473 - protein, 625 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10474 - protein, 622 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10475 - protein, 623 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10476 - protein, 619 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10477 - protein, 622 aa, Artificial Sequence
  Synthetic Polypeptide
MALPVTALLLPLALLLHAARPDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10478 - protein, 621 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10479 - protein, 630 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10480 - protein, 634 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10481 - protein, 629 aa, Artificial Sequence
  Synthetic Polypeptide
MALPVTALLLPLALLLHAARPDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10482 - protein, 625 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10483 - protein, 625 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10484 - protein, 628 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10485 - protein, 626 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10486 - protein, 625 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10487 - protein, 627 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10488 - protein, 624 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10489 - protein, 625 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10490 - protein, 626 aa, Artificial Sequence
  Synthetic Polypeptide
MALPVTALLLPLALLLHAARPDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10491 - protein, 625 aa, Artificial Sequence
  Synthetic Polypeptide
MALPVTALLLPLALLLHAARPDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10492 - protein, 620 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10493 - protein, 625 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10494 - protein, 624 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10495 - protein, 624 aa, Artificial Sequence; identical to SEQ ID NO: 10494
  Synthetic Polypeptide

SEQ ID NO: 10496 - protein, 621 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10497 - protein, 622 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10498 - protein, 623 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10499 - protein, 629 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10500 - protein, 627 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10501 - protein, 627 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10502 - protein, 625 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10503 - protein, 626 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10504 - protein, 626 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10505 - protein, 626 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10506 - protein, 624 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10507 - protein, 624 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10508 - protein, 626 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10509 - protein, 632 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFESVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10510 - protein, 623 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10511 - protein, 625 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10512 - protein, 627 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10513 - protein, 631 aa, Artificial Sequence
  Synthetic Polypeptide
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10514 - protein, 628 aa, Artificial Sequence
  Synthetic Polypeptide
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10515 - protein, 621 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10516 - protein, 625 aa, Artificial Sequence
  Synthetic Polypeptide
MALPVTALLLPLALLLHAARPQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10517 - protein, 626 aa, Artificial Sequence
  Synthetic Polypeptide
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFESSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10518 - protein, 635 aa, Artificial Sequence
  Synthetic Polypeptide
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10519 - protein, 613 aa, Artificial Sequence
  Synthetic Polypeptide
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10520 - protein, 635 aa, Artificial Sequence
  Synthetic Polypeptide
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10521 - protein, 634 aa, Artificial Sequence
  Synthetic Polypeptide
MALPVTALLLPLALLLHAARPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10522 - protein, 634 aa, Artificial Sequence
  Synthetic Polypeptide
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10523 - protein, 630 aa, Artificial Sequence
  Synthetic Polypeptide
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10524 - protein, 615 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10525 - protein, 634 aa, Artificial Sequence
  Synthetic Polypeptide
MALPVTALLLPLALLLHAARPLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10526 - protein, 624 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10527 - protein, 627 aa, Artificial Sequence
  Synthetic Polypeptide
MALPVTALLLPLALLLHAARPNFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10528 - protein, 619 aa, Artificial Sequence
  Synthetic Polypeptide
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10529 - protein, 627 aa, Artificial Sequence
  Synthetic Polypeptide
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10530 - protein, 625 aa, Artificial Sequence
  Synthetic Polypeptide
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10531 - protein, 624 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10532 - protein, 627 aa, Artificial Sequence
  Synthetic Polypeptide
MALPVTALLLPLALLLHAARPELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10533 - protein, 621 aa, Artificial Sequence
  Synthetic Polypeptide
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10534 - protein, 628 aa, Artificial Sequence
  Synthetic Polypeptide
MALPVTALLLPLALLLHAARPDVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVILVESGGGLVKPGGSLKLSCAASGFTFSSYTMSWVRQTPEKRLEWVATISSGGGNTYYPDSVKGRFTISRDNAKNNLYLQMSSLRSEDTALYYCARYYRYEAWFASWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10535 - protein, 625 aa, Artificial Sequence; identical to SEQ ID NO: 10469
  Synthetic Polypeptide

SEQ ID NO: 10536 - protein, 626 aa, Artificial Sequence
  Synthetic Polypeptide
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10537 - protein, 624 aa, Artificial Sequence
  Synthetic Polypeptide
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10538 - protein, 625 aa, Artificial Sequence
  Synthetic Polypeptide
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10539 - protein, 621 aa, Artificial Sequence
  Synthetic Polypeptide
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10540 - protein, 623 aa, Artificial Sequence
  Synthetic Polypeptide
MALPVTALLLPLALLLHAARPDVVMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGVSLPDYGVSWIRQPPGKGLEWIGVIWGSETTYYNSALKSRVLISVDTSKNQVSLKLSSVTAADTAVYYCARHYYYGGSYAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10541 - protein, 626 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10542 - protein, 636 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10543 - protein, 629 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10544 - protein, 621 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10545 - protein, 628 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10546 - protein, 621 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10547 - protein, 629 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10548 - protein, 603 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPARTAGQSYRDTVPSKQRRTPGQQGHTCVPDLRLLPWGCDSGLEGRWISCESRRGNHQAIQAEQQQIRRQLLPEPDTAVEVPQILQLPSDPRRQHRGKDSGPYRVQRQSRLRLYQRELPAGRAERHHPVRDPAGQGHPVRRAGVCPGADGYGQAEGQPGKGQAIWIWSNKLLTTQTSRRGGESRAYYGLDLAHPFPCRRCYRRAFLRTDPVGGIRGRCGAAGEPETVMRGVWLHIQELRHALGATGPRKGFGVGRRDLVRRIVLRRSCEGKVHHLPRQQKYALPANELTQGGYGGLLLRSLRDCCGRRIRLLGTGYPGDSIKHACLYKGTLRVSSGSQQQVYKRRNSRSGLPGQGLLSRACDRVLERSTDKRRAHLSSRAAKQRPVLSEQRGHSALPGHPDLHLQCEPQAQHQGGQESGTQELYPRGHILPKPREQLRREAGGKELRDRHQPELPEPERDRLQNPAAESGRLPADDPAAVVQ

SEQ ID NO: 10549 - protein, 612 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEHARKLLRSLDLYWSQPRHHSRVQVVFPSTQGWASAGSGNPLARLWNGSLTYSAMPKKATGQANPALFPRTLLSLRWCPPTWTRWTPPPITAQESLGMVGMVTTIIMGWMCGGKAQPRSQARVPLQRDPPCFLWLPAASLQAEEQPLWAAWSRITFPSLPCPGIAEHQAACTPFQPCCKAAACTLAAWSQCLALAWAPRPTSAMTTSLATPRWTREWNPRAVSPRTHSSQAPRAAATSWWKRASRQTPTTSRTASASESCCKWPALTCPCGCGP

SEQ ID NO: 10550 - protein, 621 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWRYALDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10551 - protein, 621 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10552 - protein, 626 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10553 - protein, 631 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10554 - protein, 636 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10555 - protein, 627 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10556 - protein, 623 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10557 - protein, 624 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10558 - protein, 598 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKSSDSLRPILPHCSLQAAKNSRPTRPHLCASPTSTLGLQWLGRPMDLLKPAWKPPSHPSRATTNTPPAPTAHLSSGSPTDPTAAKPTKAAPWKRQWPLQSAAAEPIAALPARATSRACAPPSCTRSCWARPPCTPCWCLPWCWLWSSGRTAGEGPSDLDLEQQTSHYSNKQVTWRRIPGLLVWTGFGASFSLSALLPARIPSNRSNCKKADPDWSLLRHLVRARSVAAPSPPIIGHGYDNPQVRAWNGLAISTIQEARTTIPASPEQFQIPVKTSSVLNCQAQLPTPLCITASHWCIVEGIVIAGSIIGDREPWLYLPRVPLQRDPPCFLWLPAASLQAEEQPLWAAWSRITFPSLPCPGIAEHQAACTPFQPCCKAAACTLAAWSQCLALAWAPRPTSAMTTSLATPRWTREWNPRAVSPRTHSSQAPRAAATSWWKRASRQTPTTSRTASASESCCKWPALTCPCGCGP

SEQ ID NO: 10559 - protein, 628 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10560 - protein, 624 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10561 - protein, 621 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10562 - protein, 622 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10563 - protein, 628 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10564 - protein, 618 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10565 - protein, 618 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 10566 - skipped

SEQ ID NO: 10567 - protein, 622 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10568 - protein, 623 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10569 - protein, 624 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10570 - protein, 631 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10571 - protein, 630 aa, Artificial Sequence
  Synthetic Polypeptide
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10572 - protein, 622 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFERAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10573 - protein, 632 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10574 - protein, 623 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10575 - protein, 627 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10576 - protein, 625 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10577 - protein, 625 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10578 - protein, 626 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10579 - protein, 623 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10580 - protein, 626 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10581 - protein, 750 aa, Artificial Sequence
  Synthetic Polypeptide
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10582 - protein, 626 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10583 - protein, 626 aa, Artificial Sequence; identical to SEQ ID NO: 10582
  Synthetic Polypeptide

SEQ ID NO: 10584 - protein, 626 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10585 - protein, 628 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10586 - protein, 629 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10587 - protein, 621 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10588 - protein, 627 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10589 - protein, 620 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10590 - protein, 625 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10591 - protein, 622 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10592 - protein, 632 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10593 - protein, 628 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10594 - protein, 632 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10595 - protein, 617 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10596 - protein, 626 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10597 - protein, 622 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10598 - protein, 630 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10599 - protein, 625 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10600 - protein, 620 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10601 - protein, 623 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10602 - protein, 618 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10603 - protein, 628 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10604 - protein, 620 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10605 - protein, 623 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10606 - protein, 633 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10607 - protein, 630 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10608 - protein, 622 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10609 - protein, 615 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10610 - protein, 620 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10611 - protein, 623 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10612 - protein, 628 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10613 - protein, 625 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10614 - protein, 623 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10615 - protein, 623 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10616 - protein, 629 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10617 - protein, 629 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10618 - protein, 627 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10619 - protein, 622 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10620 - protein, 617 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVELGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10621 - protein, 623 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10622 - protein, 630 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10623 - protein, 631 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10624 - protein, 628 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10625 - protein, 625 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10626 - protein, 626 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10627 - protein, 623 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10628 - protein, 621 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10629 - protein, 623 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10630 - protein, 625 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10631 - protein, 630 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10632 - protein, 624 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10633 - protein, 625 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10634 - protein, 623 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10635 - protein, 622 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10636 - protein, 623 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10637 - protein, 622 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10638 - protein, 623 aa, Artificial Sequence
  Synthetic Polypeptide
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10639 - protein, 630 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10640 - protein, 636 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10641 - protein, 621 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10642 - protein, 631 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEILGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10643 - protein, 611 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10644 - protein, 757 aa, Artificial Sequence
  Synthetic Polypeptide
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10645 - protein, 621 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10646 - protein, 625 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10647 - protein, 621 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10648 - protein, 622 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10649 - protein, 627 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10650 - protein, 621 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10651 - protein, 622 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10652 - protein, 630 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10653 - protein, 626 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10654 - protein, 623 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10655 - protein, 623 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10656 - protein, 622 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10657 - protein, 622 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10658 - protein, 626 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10659 - protein, 629 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10660 - protein, 631 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10661 - protein, 630 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQILGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10662 - protein, 620 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10663 - protein, 622 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10664 - protein, 624 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10665 - protein, 625 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10666 - protein, 621 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10667 - protein, 640 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10668 - protein, 637 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10669 - protein, 611 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10670 - protein, 627 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10671 - protein, 618 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10672 - protein, 619 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10673 - protein, 619 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10674 - protein, 630 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10675 - protein, 626 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10676 - protein, 621 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10677 - protein, 625 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10678 - protein, 634 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10679 - protein, 625 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10680 - protein, 628 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10681 - protein, 623 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10682 - protein, 624 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10683 - protein, 633 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10684 - protein, 623 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10685 - protein, 620 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10686 - protein, 625 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10687 - protein, 624 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10688 - protein, 626 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10689 - protein, 605 aa, Artificial Sequence
  Synthetic Polypeptide
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10690 - protein, 622 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10691 - protein, 620 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10692 - protein, 631 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10693 - protein, 626 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10694 - protein, 627 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10695 - protein, 626 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVQSGGGVMRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10696 - protein, 639 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10697 - protein, 633 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10698 - protein, 624 aa, Artificial Sequence
  Synthetic Polypeptide
MALPVTALLLPLALLLHAARPIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10699 - protein, 623 aa, Artificial Sequence
  Synthetic Polypeptide
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10700 - protein, 624 aa, Artificial Sequence
  Synthetic Polypeptide
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10701 - protein, 615 aa, Artificial Sequence
  Synthetic Polypeptide
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10702 - protein, 618 aa, Artificial Sequence
  Synthetic Polypeptide
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10703 - protein, 625 aa, Artificial Sequence
  Synthetic Polypeptide
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10704 - protein, 621 aa, Artificial Sequence
  Synthetic Polypeptide
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10705 - protein, 622 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10706 - protein, 623 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10707 - protein, 628 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10708 - protein, 624 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10709 - protein, 630 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10710 - protein, 635 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10711 - protein, 635 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10712 - protein, 624 aa, Artificial Sequence
  Synthetic Polypeptide
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10713 - protein, 625 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10714 - protein, 629 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10715 - protein, 629 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10716 - protein, 623 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10717 - protein, 625 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10718 - protein, 622 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10719 - protein, 623 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10720 - protein, 619 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10721 - protein, 622 aa, Artificial Sequence
  Synthetic Polypeptide
MALPVTALLLPLALLLHAARPDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10722 - protein, 621 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10723 - protein, 630 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10724 - protein, 634 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10725 - protein, 629 aa, Artificial Sequence
  Synthetic Polypeptide
MALPVTALLLPLALLLHAARPDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10726 - protein, 625 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10727 - protein, 625 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10728 - protein, 628 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10729 - protein, 626 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10730 - protein, 625 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10731 - protein, 627 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10732 - protein, 624 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10733 - protein, 625 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10734 - protein, 626 aa, Artificial Sequence
  Synthetic Polypeptide
MALPVTALLLPLALLLHAARPDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10735 - protein, 625 aa, Artificial Sequence
  Synthetic Polypeptide
MALPVTALLLPLALLLHAARPDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10736 - protein, 620 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10737 - protein, 625 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10738 - protein, 624 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10739 - protein, 624 aa, Artificial Sequence; identical to SEQ ID NO: 10738
  Synthetic Polypeptide

SEQ ID NO: 10740 - protein, 621 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10741 - protein, 622 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10742 - protein, 623 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10743 - protein, 629 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10744 - protein, 627 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10745 - protein, 627 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10746 - protein, 625 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10747 - protein, 626 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10748 - protein, 626 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10749 - protein, 626 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10750 - protein, 624 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10751 - protein, 624 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10752 - protein, 626 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10753 - protein, 632 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFESVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10754 - protein, 623 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10755 - protein, 625 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10756 - protein, 627 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10757 - protein, 631 aa, Artificial Sequence
  Synthetic Polypeptide
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10758 - protein, 628 aa, Artificial Sequence
  Synthetic Polypeptide
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10759 - protein, 621 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10760 - protein, 625 aa, Artificial Sequence
  Synthetic Polypeptide
MALPVTALLLPLALLLHAARPQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10761 - protein, 626 aa, Artificial Sequence
  Synthetic Polypeptide
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFESSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10762 - protein, 635 aa, Artificial Sequence
  Synthetic Polypeptide
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10763 - protein, 613 aa, Artificial Sequence
  Synthetic Polypeptide
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10764 - protein, 635 aa, Artificial Sequence
  Synthetic Polypeptide
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10765 - protein, 634 aa, Artificial Sequence
  Synthetic Polypeptide
MALPVTALLLPLALLLHAARPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10766 - protein, 634 aa, Artificial Sequence
  Synthetic Polypeptide
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10767 - protein, 630 aa, Artificial Sequence
  Synthetic Polypeptide
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10768 - protein, 615 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10769 - protein, 634 aa, Artificial Sequence
  Synthetic Polypeptide
MALPVTALLLPLALLLHAARPLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10770 - protein, 624 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10771 - protein, 627 aa, Artificial Sequence
  Synthetic Polypeptide
MALPVTALLLPLALLLHAARPNFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10772 - protein, 619 aa, Artificial Sequence
  Synthetic Polypeptide
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10773 - protein, 627 aa, Artificial Sequence
  Synthetic Polypeptide
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10774 - protein, 625 aa, Artificial Sequence
  Synthetic Polypeptide
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10775 - protein, 624 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10776 - protein, 627 aa, Artificial Sequence
  Synthetic Polypeptide
MALPVTALLLPLALLLHAARPELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10777 - protein, 621 aa, Artificial Sequence
  Synthetic Polypeptide
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10778 - protein, 628 aa, Artificial Sequence
  Synthetic Polypeptide
MALPVTALLLPLALLLHAARPDVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVILVESGGGLVKPGGSLKLSCAASGFTFSSYTMSWVRQTPEKRLEWVATISSGGGNTYYPDSVKGRFTISRDNAKNNLYLQMSSLRSEDTALYYCARYYRYEAWFASWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10779 - protein, 625 aa, Artificial Sequence; identical to SEQ ID NO: 10713
  Synthetic Polypeptide

SEQ ID NO: 10780 - protein, 626 aa, Artificial Sequence
  Synthetic Polypeptide
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10781 - protein, 624 aa, Artificial Sequence
  Synthetic Polypeptide
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10782 - protein, 625 aa, Artificial Sequence
  Synthetic Polypeptide
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10783 - protein, 621 aa, Artificial Sequence
  Synthetic Polypeptide
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10784 - protein, 623 aa, Artificial Sequence
  Synthetic Polypeptide
MALPVTALLLPLALLLHAARPDVVMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGVSLPDYGVSWIRQPPGKGLEWIGVIWGSETTYYNSALKSRVLISVDTSKNQVSLKLSSVTAADTAVYYCARHYYYGGSYAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10785 - protein, 626 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10786 - protein, 636 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10787 - protein, 629 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10788 - protein, 621 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10789 - protein, 628 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10790 - protein, 621 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10791 - protein, 629 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10792 - protein, 603 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPARTAGQSYRDTVPSKQRRTPGQQGHTCVPDLRLLPWGCDSGLEGRWISCESRRGNHQAIQAEQQQIRRQLLPEPDTAVEVPQILQLPSDPRRQHRGKDSGPYRVQRQSRLRLYQRELPAGRAERHHPVRDPAGQGHPVRRAGVCPGADGYGQAEGQPGKGQAIWIWSNKLLTTQTSRRGGESRAYYGLDLAHPFPCRRCYRRAFLRTDPVGGIRGRCGAAGEPETVMRGVWLHIQELRHALGATGPRKGFGVGRRDLVRRIVLRRSCEGKVHHLPRQQKYALPANELTQGGYGGLLLRSLRDCCGRRIRLLGTGYPGDSIKHACLYKGTLRVSSGSQQQVYKRRNSRSGLPGQGLLSRACDRVLERSTDKRRAHLSSRAAKQRPVLSEQRGHSALPGHPDLHLQCEPQAQHQGGQESGTQELYPRGHILPKPREQLRREAGGKELRDRHQPELPEPERDRLPDPAAESGRLPADDPAAVVQ

SEQ ID NO: 10793 - protein, 611 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEHARKLLRSLDLYWSQPRHHSRVQVVFPSTQGWASAGSGNPLARLWNGSLTYSAMPKKATGQANPALFPRTLLSLRWCPPTWTRWTPPPITAQESLGMVGMVTTIIMGWMCGGKAQPRSQARVPLQRDPPCFLWLPAASLQAEEQPLWAAWSRITFPSLPCPGIAEHQAACTPFQPCCKAAACTLAAWSQCLALAWAPRPTSAMTTSLATPRWTREWNPRAVSPRTHSSQAPRAAATSWWKRASRQTPTTSRTASASSCCKWPALTCPCGCGP

SEQ ID NO: 10794 - protein, 621 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWRYALDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10795 - protein, 621 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10796 - protein, 626 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10797 - protein, 631 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10798 - protein, 636 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10799 - protein, 627 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10800 - protein, 623 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10801 - protein, 624 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10802 - protein, 597 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKSSDSLRPILPHCSLQAAKNSRPTRPHLCASPTSTLGLQWLGRPMDLLKPAWKPPSHPSRATTNTPPAPTAHLSSGSPTDPTAAKPTKAAPWKRQWPLQSAAAEPIAALPARATSRACAPPSCTRSCWARPPCTPCWCLPWCWLWSSGRTAGEGPSDLDLEQQTSHYSNKQVTWRRIPGLLVWTGFGASFSLSALLPARIPSNRSNCKKADPDWSLLRHLVRARSVAAPSPPIIGHGYDNPQVRAWNGLAISTIQEARTTIPASPEQFQIPVKTSSVLNCQAQLPTPLCITASHWCIVEGIVIAGSIIGDREPWLYLPRVPLQRDPPCFLWLPAASLQAEEQPLWAAWSRITFPSLPCPGIAEHQAACTPFQPCCKAAACTLAAWSQCLALAWAPRPTSAMTTSLATPRWTREWNPRAVSPRTHSSQAPRAAATSWWKRASRQTPTTSRTASASSCCKWPALTCPCGCGP

SEQ ID NO: 10803 - protein, 628 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10804 - protein, 624 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10805 - protein, 621 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10806 - protein, 622 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10807 - protein, 628 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10808 - protein, 618 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10809 - protein, 618 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 10810 - skipped

SEQ ID NO: 10811 - protein, 622 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10812 - protein, 623 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10813 - protein, 624 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10814 - protein, 631 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10815 - protein, 630 aa, Artificial Sequence
  Synthetic Polypeptide
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10816 - protein, 622 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFERAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10817 - protein, 632 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10818 - protein, 623 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10819 - protein, 627 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10820 - protein, 625 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10821 - protein, 625 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10822 - protein, 626 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10823 - protein, 623 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10824 - protein, 626 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10825 - protein, 750 aa, Artificial Sequence
  Synthetic Polypeptide
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10826 - protein, 626 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10827 - protein, 626 aa, Artificial Sequence; identical to SEQ ID NO: 10826
  Synthetic Polypeptide

SEQ ID NO: 10828 - protein, 626 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10829 - protein, 628 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10830 - protein, 629 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10831 - protein, 621 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10832 - protein, 627 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10833 - protein, 620 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10834 - protein, 625 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10835 - protein, 622 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10836 - protein, 632 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10837 - protein, 628 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10838 - protein, 632 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10839 - protein, 617 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10840 - protein, 626 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10841 - protein, 622 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10842 - protein, 630 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10843 - protein, 625 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10844 - protein, 620 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10845 - protein, 623 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10846 - protein, 618 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10847 - protein, 628 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10848 - protein, 620 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10849 - protein, 623 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10850 - protein, 633 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10851 - protein, 630 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10852 - protein, 622 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10853 - protein, 615 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10854 - protein, 620 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10855 - protein, 623 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10856 - protein, 628 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10857 - protein, 625 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10858 - protein, 623 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10859 - protein, 623 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10860 - protein, 629 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10861 - protein, 629 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10862 - protein, 627 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10863 - protein, 622 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10864 - protein, 617 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVELGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10865 - protein, 623 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10866 - protein, 630 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10867 - protein, 631 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10868 - protein, 628 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10869 - protein, 625 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10870 - protein, 626 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10871 - protein, 623 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10872 - protein, 621 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10873 - protein, 623 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10874 - protein, 625 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10875 - protein, 630 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10876 - protein, 624 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10877 - protein, 625 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10878 - protein, 623 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10879 - protein, 622 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10880 - protein, 623 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10881 - protein, 622 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10882 - protein, 623 aa, Artificial Sequence
  Synthetic Polypeptide
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10883 - protein, 630 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10884 - protein, 636 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10885 - protein, 621 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10886 - protein, 631 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEILGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10887 - protein, 611 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10888 - protein, 757 aa, Artificial Sequence
  Synthetic Polypeptide
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10889 - protein, 621 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10890 - protein, 625 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10891 - protein, 621 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10892 - protein, 622 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10893 - protein, 627 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10894 - protein, 621 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10895 - protein, 622 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10896 - protein, 630 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10897 - protein, 626 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10898 - protein, 623 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10899 - protein, 623 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10900 - protein, 622 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10901 - protein, 622 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10902 - protein, 626 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10903 - protein, 629 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10904 - protein, 631 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10905 - protein, 630 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQILGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10906 - protein, 620 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10907 - protein, 622 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10908 - protein, 624 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10909 - protein, 625 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10910 - protein, 621 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10911 - protein, 640 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10912 - protein, 637 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10913 - protein, 611 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10914 - protein, 627 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10915 - protein, 618 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10916 - protein, 619 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10917 - protein, 619 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10918 - protein, 630 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10919 - protein, 626 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10920 - protein, 621 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10921 - protein, 625 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10922 - protein, 634 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10923 - protein, 625 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10924 - protein, 628 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10925 - protein, 623 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10926 - protein, 624 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10927 - protein, 633 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10928 - protein, 623 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10929 - protein, 620 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10930 - protein, 625 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10931 - protein, 624 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10932 - protein, 626 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10933 - protein, 605 aa, Artificial Sequence
  Synthetic Polypeptide
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10934 - protein, 622 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10935 - protein, 620 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10936 - protein, 631 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10937 - protein, 626 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10938 - protein, 627 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10939 - protein, 626 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVQSGGGVMRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10940 - protein, 639 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10941 - protein, 633 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10942 - protein, 624 aa, Artificial Sequence
  Synthetic Polypeptide
MALPVTALLLPLALLLHAARPIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10943 - protein, 623 aa, Artificial Sequence
  Synthetic Polypeptide
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10944 - protein, 624 aa, Artificial Sequence
  Synthetic Polypeptide
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10945 - protein, 615 aa, Artificial Sequence
  Synthetic Polypeptide
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10946 - protein, 618 aa, Artificial Sequence
  Synthetic Polypeptide
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10947 - protein, 625 aa, Artificial Sequence
  Synthetic Polypeptide
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10948 - protein, 621 aa, Artificial Sequence
  Synthetic Polypeptide
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10949 - protein, 622 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10950 - protein, 623 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10951 - protein, 628 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10952 - protein, 624 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10953 - protein, 630 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10954 - protein, 635 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10955 - protein, 635 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10956 - protein, 624 aa, Artificial Sequence
  Synthetic Polypeptide
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10957 - protein, 625 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10958 - protein, 629 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10959 - protein, 629 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10960 - protein, 623 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10961 - protein, 625 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10962 - protein, 622 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10963 - protein, 623 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10964 - protein, 619 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10965 - protein, 622 aa, Artificial Sequence
  Synthetic Polypeptide
MALPVTALLLPLALLLHAARPDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10966 - protein, 621 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10967 - protein, 630 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10968 - protein, 634 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10969 - protein, 629 aa, Artificial Sequence
  Synthetic Polypeptide
MALPVTALLLPLALLLHAARPDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10970 - protein, 625 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10971 - protein, 625 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10972 - protein, 628 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10973 - protein, 626 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10974 - protein, 625 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10975 - protein, 627 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10976 - protein, 624 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10977 - protein, 625 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10978 - protein, 626 aa, Artificial Sequence
  Synthetic Polypeptide
MALPVTALLLPLALLLHAARPDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10979 - protein, 625 aa, Artificial Sequence
  Synthetic Polypeptide
MALPVTALLLPLALLLHAARPDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10980 - protein, 620 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10981 - protein, 625 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10982 - protein, 624 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10983 - protein, 624 aa, Artificial Sequence; identical to SEQ ID NO: 10982
  Synthetic Polypeptide

SEQ ID NO: 10984 - protein, 621 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10985 - protein, 622 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10986 - protein, 623 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10987 - protein, 629 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10988 - protein, 627 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10989 - protein, 627 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10990 - protein, 625 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10991 - protein, 626 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10992 - protein, 626 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10993 - protein, 626 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10994 - protein, 624 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10995 - protein, 624 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10996 - protein, 626 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10997 - protein, 632 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFESVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10998 - protein, 623 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 10999 - protein, 625 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11000 - protein, 627 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11001 - protein, 631 aa, Artificial Sequence
  Synthetic Polypeptide
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11002 - protein, 628 aa, Artificial Sequence
  Synthetic Polypeptide
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11003 - protein, 621 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11004 - protein, 625 aa, Artificial Sequence
  Synthetic Polypeptide
MALPVTALLLPLALLLHAARPQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11005 - protein, 626 aa, Artificial Sequence
  Synthetic Polypeptide
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFESSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11006 - protein, 635 aa, Artificial Sequence
  Synthetic Polypeptide
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11007 - protein, 613 aa, Artificial Sequence
  Synthetic Polypeptide
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11008 - protein, 635 aa, Artificial Sequence
  Synthetic Polypeptide
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11009 - protein, 634 aa, Artificial Sequence
  Synthetic Polypeptide
MALPVTALLLPLALLLHAARPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11010 - protein, 634 aa, Artificial Sequence
  Synthetic Polypeptide
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11011 - protein, 630 aa, Artificial Sequence
  Synthetic Polypeptide
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11012 - protein, 615 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11013 - protein, 634 aa, Artificial Sequence
  Synthetic Polypeptide
MALPVTALLLPLALLLHAARPLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11014 - protein, 624 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11015 - protein, 627 aa, Artificial Sequence
  Synthetic Polypeptide
MALPVTALLLPLALLLHAARPNFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11016 - protein, 619 aa, Artificial Sequence
  Synthetic Polypeptide
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11017 - protein, 627 aa, Artificial Sequence
  Synthetic Polypeptide
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11018 - protein, 625 aa, Artificial Sequence
  Synthetic Polypeptide
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11019 - protein, 624 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11020 - protein, 627 aa, Artificial Sequence
  Synthetic Polypeptide
MALPVTALLLPLALLLHAARPELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11021 - protein, 621 aa, Artificial Sequence
  Synthetic Polypeptide
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11022 - protein, 628 aa, Artificial Sequence
  Synthetic Polypeptide
MALPVTALLLPLALLLHAARPDVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVILVESGGGLVKPGGSLKLSCAASGFTFSSYTMSWVRQTPEKRLEWVATISSGGGNTYYPDSVKGRFTISRDNAKNNLYLQMSSLRSEDTALYYCARYYRYEAWFASWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11023 - protein, 625 aa, Artificial Sequence; identical to SEQ ID NO: 10957
  Synthetic Polypeptide

SEQ ID NO: 11024 - protein, 626 aa, Artificial Sequence
  Synthetic Polypeptide
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11025 - protein, 624 aa, Artificial Sequence
  Synthetic Polypeptide
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11026 - protein, 625 aa, Artificial Sequence
  Synthetic Polypeptide
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11027 - protein, 621 aa, Artificial Sequence
  Synthetic Polypeptide
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11028 - protein, 623 aa, Artificial Sequence
  Synthetic Polypeptide
MALPVTALLLPLALLLHAARPDVVMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGVSLPDYGVSWIRQPPGKGLEWIGVIWGSETTYYNSALKSRVLISVDTSKNQVSLKLSSVTAADTAVYYCARHYYYGGSYAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11029 - protein, 626 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11030 - protein, 636 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11031 - protein, 629 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11032 - protein, 621 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11033 - protein, 628 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11034 - protein, 621 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11035 - protein, 629 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11036 - protein, 604 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPARTAGQSYRDTVPSKQRRTPGQQGHTCVPDLRLLPWGCDSGLEGRWISCESRRGNHQAIQAEQQQIRRQLLPEPDTAVEVPQILQLPSDPRRQHRGKDSGPYRVQRQSRLRLYQRELPAGRAERHHPVRDPAGQGHPVRRAGVCPGADGYGQAEGQPGKGQAIWIWSNKLLTTQTSRRGGESRAYYGLDLAHPFPCRRCYRRAFLRTDPVGGIRGRCGAAGEPETVMRGVWLHIQELRHALGATGPRKGFGVGRRDLVRRIVLRRSCEGKVHHLPRQQKYALPANELTQGGYGGLLLRSLRDCCGRRIRLLGTGYPGDSIKHACLYKGTLRVSSGSQQQVYKRRNSRSGLPGQGLLSRACDRVLERSTDKRRAHLSSRAAKQRPVLSEQRGHSALPGHPDLHLQCEPQAQHQGGQESGTQELYPRGHILPKPREQLRREAGGKELRDRHQPELPEPERDRLQNPAAESGPVCPADDPAAVVQ

SEQ ID NO: 11037 - protein, 612 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEHARKLLRSLDLYWSQPRHHSRVQVVFPSTQGWASAGSGNPLARLWNGSLTYSAMPKKATGQANPALFPRTLLSLRWCPPTWTRWTPPPITAQESLGMVGMVTTIIMGWMCGGKAQPRSQARVPLQRDPPCFLWLPAASLQAEEQPLWAAWSRITFPSLPCPGIAEHQAACTPFQPCCKAAACTLAAWSQCLALAWAPRPTSAMTTSLATPRWTREWNPRAVSPRTHSSQAPRAAATSWWKRASRQTPTTSRTASASESCCKWPCLPCPCGCGP

SEQ ID NO: 11038 - protein, 621 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWRYALDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11039 - protein, 621 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11040 - protein, 626 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11041 - protein, 631 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11042 - protein, 636 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11043 - protein, 627 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11044 - protein, 623 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11045 - protein, 624 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11046 - protein, 598 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKSSDSLRPILPHCSLQAAKNSRPTRPHLCASPTSTLGLQWLGRPMDLLKPAWKPPSHPSRATTNTPPAPTAHLSSGSPTDPTAAKPTKAAPWKRQWPLQSAAAEPIAALPARATSRACAPPSCTRSCWARPPCTPCWCLPWCWLWSSGRTAGEGPSDLDLEQQTSHYSNKQVTWRRIPGLLVWTGFGASFSLSALLPARIPSNRSNCKKADPDWSLLRHLVRARSVAAPSPPIIGHGYDNPQVRAWNGLAISTIQEARTTIPASPEQFQIPVKTSSVLNCQAQLPTPLCITASHWCIVEGIVIAGSIIGDREPWLYLPRVPLQRDPPCFLWLPAASLQAEEQPLWAAWSRITFPSLPCPGIAEHQAACTPFQPCCKAAACTLAAWSQCLALAWAPRPTSAMTTSLATPRWTREWNPRAVSPRTHSSQAPRAAATSWWKRASRQTPTTSRTASASESCCKWPCLPCPCGCGP

SEQ ID NO: 11047 - protein, 628 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11048 - protein, 624 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11049 - protein, 621 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11050 - protein, 622 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11051 - protein, 628 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11052 - protein, 618 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11053 - protein, 618 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 11054 - skipped

SEQ ID NO: 11055 - protein, 626 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11056 - protein, 627 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11057 - protein, 628 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11058 - protein, 635 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11059 - protein, 634 aa, Artificial Sequence
  Synthetic Polypeptide
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11060 - protein, 626 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFERAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11061 - protein, 636 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11062 - protein, 627 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11063 - protein, 631 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11064 - protein, 629 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11065 - protein, 629 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11066 - protein, 630 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11067 - protein, 627 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11068 - protein, 630 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11069 - protein, 754 aa, Artificial Sequence
  Synthetic Polypeptide
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11070 - protein, 630 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11071 - protein, 630 aa, Artificial Sequence; identical to SEQ ID NO: 11070
  Synthetic Polypeptide

SEQ ID NO: 11072 - protein, 630 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11073 - protein, 632 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11074 - protein, 633 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11075 - protein, 625 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11076 - protein, 631 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11077 - protein, 624 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11078 - protein, 629 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11079 - protein, 626 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11080 - protein, 636 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11081 - protein, 632 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11082 - protein, 636 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11083 - protein, 621 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11084 - protein, 630 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11085 - protein, 626 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11086 - protein, 634 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11087 - protein, 629 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11088 - protein, 624 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11089 - protein, 627 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11090 - protein, 622 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11091 - protein, 632 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11092 - protein, 624 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11093 - protein, 627 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11094 - protein, 637 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11095 - protein, 634 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11096 - protein, 626 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11097 - protein, 619 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11098 - protein, 624 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11099 - protein, 627 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11100 - protein, 632 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11101 - protein, 629 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11102 - protein, 627 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11103 - protein, 627 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11104 - protein, 633 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11105 - protein, 633 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11106 - protein, 631 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11107 - protein, 626 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11108 - protein, 621 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVELEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11109 - protein, 627 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11110 - protein, 634 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11111 - protein, 635 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11112 - protein, 632 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11113 - protein, 629 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11114 - protein, 630 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11115 - protein, 627 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11116 - protein, 625 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11117 - protein, 627 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11118 - protein, 629 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11119 - protein, 634 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11120 - protein, 628 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11121 - protein, 629 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11122 - protein, 627 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11123 - protein, 626 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11124 - protein, 627 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11125 - protein, 626 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11126 - protein, 627 aa, Artificial Sequence
  Synthetic Polypeptide
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11127 - protein, 634 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11128 - protein, 640 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11129 - protein, 625 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11130 - protein, 635 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEILEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFELEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11131 - protein, 615 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11132 - protein, 761 aa, Artificial Sequence
  Synthetic Polypeptide
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11133 - protein, 625 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11134 - protein, 629 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11135 - protein, 625 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11136 - protein, 626 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11137 - protein, 631 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11138 - protein, 625 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11139 - protein, 626 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11140 - protein, 634 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11141 - protein, 630 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11142 - protein, 627 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11143 - protein, 627 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11144 - protein, 626 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11145 - protein, 626 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11146 - protein, 630 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11147 - protein, 633 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11148 - protein, 635 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11149 - protein, 634 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQILEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11150 - protein, 624 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11151 - protein, 626 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11152 - protein, 628 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11153 - protein, 629 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11154 - protein, 625 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11155 - protein, 644 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11156 - protein, 641 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11157 - protein, 615 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11158 - protein, 631 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11159 - protein, 622 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11160 - protein, 623 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11161 - protein, 623 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11162 - protein, 634 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11163 - protein, 630 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11164 - protein, 625 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11165 - protein, 629 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11166 - protein, 638 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11167 - protein, 629 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11168 - protein, 632 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11169 - protein, 627 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11170 - protein, 628 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11171 - protein, 637 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11172 - protein, 627 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11173 - protein, 624 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11174 - protein, 629 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11175 - protein, 628 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11176 - protein, 630 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11177 - protein, 609 aa, Artificial Sequence
  Synthetic Polypeptide
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11178 - protein, 626 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11179 - protein, 624 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11180 - protein, 635 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11181 - protein, 630 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11182 - protein, 631 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11183 - protein, 630 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEVQLVQSGGGVMRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11184 - protein, 643 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11185 - protein, 637 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11186 - protein, 629 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11187 - protein, 628 aa, Artificial Sequence
  Synthetic Polypeptide
MALPVTALLLPLALLLHAARPDEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11188 - protein, 629 aa, Artificial Sequence
  Synthetic Polypeptide
MALPVTALLLPLALLLHAARPDDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11189 - protein, 620 aa, Artificial Sequence
  Synthetic Polypeptide
MALPVTALLLPLALLLHAARPDDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11190 - protein, 623 aa, Artificial Sequence
  Synthetic Polypeptide
MALPVTALLLPLALLLHAARPDDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11191 - protein, 630 aa, Artificial Sequence
  Synthetic Polypeptide
MALPVTALLLPLALLLHAARPDDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11192 - protein, 626 aa, Artificial Sequence
  Synthetic Polypeptide
MALPVTALLLPLALLLHAARPDDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11193 - protein, 626 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11194 - protein, 627 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11195 - protein, 632 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11196 - protein, 628 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11197 - protein, 634 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11198 - protein, 639 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11199 - protein, 639 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFELEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11200 - protein, 629 aa, Artificial Sequence; identical to SEQ ID NO: 11065
  Synthetic Polypeptide

SEQ ID NO: 11201 - protein, 629 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11202 - protein, 633 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11203 - protein, 633 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11204 - protein, 627 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11205 - protein, 629 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11206 - protein, 626 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11207 - protein, 627 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11208 - protein, 623 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11209 - protein, 626 aa, Artificial Sequence
  Synthetic Polypeptide
MALPVTALLLPLALLLHAARPDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11210 - protein, 625 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11211 - protein, 634 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11212 - protein, 638 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11213 - protein, 633 aa, Artificial Sequence
  Synthetic Polypeptide
MALPVTALLLPLALLLHAARPDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11214 - protein, 629 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11215 - protein, 629 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11216 - protein, 632 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11217 - protein, 630 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11218 - protein, 629 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11219 - protein, 631 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11220 - protein, 628 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11221 - protein, 629 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11222 - protein, 630 aa, Artificial Sequence
  Synthetic Polypeptide
MALPVTALLLPLALLLHAARPDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11223 - protein, 629 aa, Artificial Sequence
  Synthetic Polypeptide
MALPVTALLLPLALLLHAARPDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11224 - protein, 624 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11225 - protein, 629 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11226 - protein, 628 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11227 - protein, 628 aa, Artificial Sequence; identical to SEQ ID NO: 11226
  Synthetic Polypeptide

SEQ ID NO: 11228 - protein, 625 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11229 - protein, 626 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11230 - protein, 627 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11231 - protein, 633 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11232 - protein, 631 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11233 - protein, 631 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11234 - protein, 629 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11235 - protein, 630 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11236 - protein, 630 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11237 - protein, 630 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11238 - protein, 628 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11239 - protein, 628 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11240 - protein, 630 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11241 - protein, 636 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFESVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11242 - protein, 627 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11243 - protein, 629 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11244 - protein, 631 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11245 - protein, 635 aa, Artificial Sequence
  Synthetic Polypeptide
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFELEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11246 - protein, 632 aa, Artificial Sequence
  Synthetic Polypeptide
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11247 - protein, 625 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11248 - protein, 629 aa, Artificial Sequence
  Synthetic Polypeptide
MALPVTALLLPLALLLHAARPQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11249 - protein, 630 aa, Artificial Sequence
  Synthetic Polypeptide
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFESSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11250 - protein, 639 aa, Artificial Sequence
  Synthetic Polypeptide
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11251 - protein, 617 aa, Artificial Sequence
  Synthetic Polypeptide
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11252 - protein, 639 aa, Artificial Sequence
  Synthetic Polypeptide
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11253 - protein, 638 aa, Artificial Sequence
  Synthetic Polypeptide
MALPVTALLLPLALLLHAARPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11254 - protein, 638 aa, Artificial Sequence
  Synthetic Polypeptide
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11255 - protein, 634 aa, Artificial Sequence
  Synthetic Polypeptide
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11256 - protein, 619 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11257 - protein, 638 aa, Artificial Sequence
  Synthetic Polypeptide
MALPVTALLLPLALLLHAARPLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11258 - protein, 628 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11259 - protein, 631 aa, Artificial Sequence
  Synthetic Polypeptide
MALPVTALLLPLALLLHAARPNFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11260 - protein, 623 aa, Artificial Sequence
  Synthetic Polypeptide
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11261 - protein, 631 aa, Artificial Sequence
  Synthetic Polypeptide
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11262 - protein, 629 aa, Artificial Sequence
  Synthetic Polypeptide
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11263 - protein, 628 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11264 - protein, 631 aa, Artificial Sequence
  Synthetic Polypeptide
MALPVTALLLPLALLLHAARPELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11265 - protein, 625 aa, Artificial Sequence
  Synthetic Polypeptide
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11266 - protein, 632 aa, Artificial Sequence
  Synthetic Polypeptide
MALPVTALLLPLALLLHAARPDVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVILVESGGGLVKPGGSLKLSCAASGFTFSSYTMSWVRQTPEKRLEWVATISSGGGNTYYPDSVKGRFTISRDNAKNNLYLQMSSLRSEDTALYYCARYYRYEAWFASWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11267 - protein, 629 aa, Artificial Sequence; identical to SEQ ID NO: 11201
  Synthetic Polypeptide

SEQ ID NO: 11268 - protein, 630 aa, Artificial Sequence
  Synthetic Polypeptide
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11269 - protein, 628 aa, Artificial Sequence
  Synthetic Polypeptide
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11270 - protein, 629 aa, Artificial Sequence
  Synthetic Polypeptide
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11271 - protein, 625 aa, Artificial Sequence
  Synthetic Polypeptide
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11272 - protein, 627 aa, Artificial Sequence
  Synthetic Polypeptide
MALPVTALLLPLALLLHAARPDVVMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGVSLPDYGVSWIRQPPGKGLEWIGVIWGSETTYYNSALKSRVLISVDTSKNQVSLKLSSVTAADTAVYYCARHYYYGGSYAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11273 - protein, 629 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11274 - protein, 640 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11275 - protein, 633 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11276 - protein, 625 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11277 - protein, 632 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11278 - protein, 625 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11279 - protein, 633 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11280 - protein, 601 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRASRPLQRDPPCFLWLPAASLQAEEQPLWAAWSRITFPSLPCPGIAEHQAACTPFQPCCKAAACTLAAWSQCLALAWAPRPTSAMTTSLATPRWTREWNPRAVSPRTHSSQAPRAAATSWWKRASRQTPTTSRTASASESCCKWPALTCPCGCGPAAPREADLASRPISTCSWLATWNPTQALLVWTGFGASFSLSALLPARIPSNRSSWWNQGAVWCSRVGADCHAWRLASHSRTTACTGCDRPPERVWSGSPSGTTDLMSITEILREGSPSPATIAKICSTCKTHSGRMIRRSTIALAQGLLWPAHSITGDRVPWQYQARVDSLRPILPHCSLQAAKNSRPTRPHLCASPTSTLGLQWLGRPMDLLKPAWKPPSHPSRATTNTPPAPTAHLSSGSPTDPTAAKPTKAAPWKRQWPLQSAAAEPIAALPARATSRACAPPSCTRSCWARPPCTPCWCLPWCWLWSSGRTAG

SEQ ID NO: 11281 - protein, 635 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11282 - protein, 625 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWRYALDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11283 - protein, 625 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11284 - protein, 630 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11285 - protein, 635 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11286 - protein, 640 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11287 - protein, 631 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11288 - protein, 627 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11289 - protein, 628 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11290 - protein, 630 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11291 - protein, 632 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11292 - protein, 628 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11293 - protein, 625 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11294 - protein, 626 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11295 - protein, 632 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11296 - protein, 622 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11297 - protein, 622 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11298 - skipped

SEQ ID NO: 11299 - protein, 626 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11300 - protein, 627 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11301 - protein, 628 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11302 - protein, 635 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11303 - protein, 634 aa, Artificial Sequence
  Synthetic Polypeptide
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11304 - protein, 626 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFERAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11305 - protein, 636 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11306 - protein, 627 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11307 - protein, 631 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11308 - protein, 629 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11309 - protein, 629 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11310 - protein, 630 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11311 - protein, 627 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11312 - protein, 630 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11313 - protein, 754 aa, Artificial Sequence
  Synthetic Polypeptide
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11314 - protein, 630 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11315 - protein, 630 aa, Artificial Sequence; identical to SEQ ID NO: 11314
  Synthetic Polypeptide

SEQ ID NO: 11316 - protein, 630 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11317 - protein, 632 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11318 - protein, 633 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11319 - protein, 625 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11320 - protein, 631 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11321 - protein, 624 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11322 - protein, 629 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11323 - protein, 626 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11324 - protein, 636 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11325 - protein, 632 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11326 - protein, 636 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11327 - protein, 621 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11328 - protein, 630 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11329 - protein, 626 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11330 - protein, 634 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11331 - protein, 629 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11332 - protein, 624 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11333 - protein, 627 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11334 - protein, 622 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11335 - protein, 632 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11336 - protein, 624 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11337 - protein, 627 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11338 - protein, 637 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11339 - protein, 634 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11340 - protein, 626 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11341 - protein, 619 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11342 - protein, 624 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11343 - protein, 627 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11344 - protein, 632 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11345 - protein, 629 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11346 - protein, 627 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11347 - protein, 627 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11348 - protein, 633 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11349 - protein, 633 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11350 - protein, 631 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11351 - protein, 626 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11352 - protein, 621 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVELEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11353 - protein, 627 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11354 - protein, 634 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11355 - protein, 635 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11356 - protein, 632 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11357 - protein, 629 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11358 - protein, 630 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11359 - protein, 627 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11360 - protein, 625 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11361 - protein, 627 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11362 - protein, 629 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11363 - protein, 634 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11364 - protein, 628 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11365 - protein, 629 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11366 - protein, 627 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11367 - protein, 626 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11368 - protein, 627 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11369 - protein, 626 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11370 - protein, 627 aa, Artificial Sequence
  Synthetic Polypeptide
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11371 - protein, 634 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11372 - protein, 640 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11373 - protein, 625 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11374 - protein, 635 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEILEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFELEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11375 - protein, 615 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11376 - protein, 761 aa, Artificial Sequence
  Synthetic Polypeptide
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11377 - protein, 625 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11378 - protein, 629 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11379 - protein, 625 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11380 - protein, 626 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11381 - protein, 631 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11382 - protein, 625 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11383 - protein, 626 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11384 - protein, 634 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11385 - protein, 630 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11386 - protein, 627 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11387 - protein, 627 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11388 - protein, 626 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11389 - protein, 626 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11390 - protein, 630 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11391 - protein, 633 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11392 - protein, 635 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11393 - protein, 634 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQILEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11394 - protein, 624 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11395 - protein, 626 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11396 - protein, 628 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11397 - protein, 629 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11398 - protein, 625 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11399 - protein, 644 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11400 - protein, 641 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11401 - protein, 615 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11402 - protein, 631 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11403 - protein, 622 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11404 - protein, 623 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11405 - protein, 623 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11406 - protein, 634 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11407 - protein, 630 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11408 - protein, 625 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11409 - protein, 629 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11410 - protein, 638 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11411 - protein, 629 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11412 - protein, 632 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11413 - protein, 627 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11414 - protein, 628 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11415 - protein, 637 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11416 - protein, 627 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11417 - protein, 624 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11418 - protein, 629 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11419 - protein, 628 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11420 - protein, 630 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11421 - protein, 609 aa, Artificial Sequence
  Synthetic Polypeptide
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11422 - protein, 626 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11423 - protein, 624 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11424 - protein, 635 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11425 - protein, 630 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11426 - protein, 631 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11427 - protein, 630 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVQLVQSGGGVMRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11428 - protein, 643 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11429 - protein, 637 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11430 - protein, 629 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11431 - protein, 628 aa, Artificial Sequence
  Synthetic Polypeptide
MALPVTALLLPLALLLHAARPDEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11432 - protein, 629 aa, Artificial Sequence
  Synthetic Polypeptide
MALPVTALLLPLALLLHAARPDDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11433 - protein, 620 aa, Artificial Sequence
  Synthetic Polypeptide
MALPVTALLLPLALLLHAARPDDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11434 - protein, 623 aa, Artificial Sequence
  Synthetic Polypeptide
MALPVTALLLPLALLLHAARPDDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11435 - protein, 630 aa, Artificial Sequence
  Synthetic Polypeptide
MALPVTALLLPLALLLHAARPDDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11436 - protein, 626 aa, Artificial Sequence
  Synthetic Polypeptide
MALPVTALLLPLALLLHAARPDDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11437 - protein, 626 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11438 - protein, 627 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11439 - protein, 632 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11440 - protein, 628 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11441 - protein, 634 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11442 - protein, 639 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11443 - protein, 639 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFELEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11444 - protein, 629 aa, Artificial Sequence; identical to SEQ ID NO: 11309
  Synthetic Polypeptide

SEQ ID NO: 11445 - protein, 629 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11446 - protein, 633 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11447 - protein, 633 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11448 - protein, 627 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11449 - protein, 629 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11450 - protein, 626 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11451 - protein, 627 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11452 - protein, 623 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11453 - protein, 626 aa, Artificial Sequence
  Synthetic Polypeptide
MALPVTALLLPLALLLHAARPDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11454 - protein, 625 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11455 - protein, 634 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11456 - protein, 638 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11457 - protein, 633 aa, Artificial Sequence
  Synthetic Polypeptide
MALPVTALLLPLALLLHAARPDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11458 - protein, 629 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11459 - protein, 629 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11460 - protein, 632 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11461 - protein, 630 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11462 - protein, 629 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11463 - protein, 631 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11464 - protein, 628 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11465 - protein, 629 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11466 - protein, 630 aa, Artificial Sequence
  Synthetic Polypeptide
MALPVTALLLPLALLLHAARPDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11467 - protein, 629 aa, Artificial Sequence
  Synthetic Polypeptide
MALPVTALLLPLALLLHAARPDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11468 - protein, 624 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11469 - protein, 629 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11470 - protein, 628 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11471 - protein, 628 aa, Artificial Sequence; identical to SEQ ID NO: 11470
  Synthetic Polypeptide

SEQ ID NO: 11472 - protein, 625 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11473 - protein, 626 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11474 - protein, 627 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11475 - protein, 633 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11476 - protein, 631 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11477 - protein, 631 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11478 - protein, 629 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11479 - protein, 630 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11480 - protein, 630 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11481 - protein, 630 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11482 - protein, 628 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11483 - protein, 628 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11484 - protein, 630 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11485 - protein, 636 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFESVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11486 - protein, 627 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11487 - protein, 629 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11488 - protein, 631 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11489 - protein, 635 aa, Artificial Sequence
  Synthetic Polypeptide
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFELEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11490 - protein, 632 aa, Artificial Sequence
  Synthetic Polypeptide
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11491 - protein, 625 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11492 - protein, 629 aa, Artificial Sequence
  Synthetic Polypeptide
MALPVTALLLPLALLLHAARPQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11493 - protein, 630 aa, Artificial Sequence
  Synthetic Polypeptide
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFESSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11494 - protein, 639 aa, Artificial Sequence
  Synthetic Polypeptide
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11495 - protein, 617 aa, Artificial Sequence
  Synthetic Polypeptide
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11496 - protein, 639 aa, Artificial Sequence
  Synthetic Polypeptide
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11497 - protein, 638 aa, Artificial Sequence
  Synthetic Polypeptide
MALPVTALLLPLALLLHAARPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11498 - protein, 638 aa, Artificial Sequence
  Synthetic Polypeptide
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11499 - protein, 634 aa, Artificial Sequence
  Synthetic Polypeptide
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11500 - protein, 619 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11501 - protein, 638 aa, Artificial Sequence
  Synthetic Polypeptide
MALPVTALLLPLALLLHAARPLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11502 - protein, 628 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11503 - protein, 631 aa, Artificial Sequence
  Synthetic Polypeptide
MALPVTALLLPLALLLHAARPNFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11504 - protein, 623 aa, Artificial Sequence
  Synthetic Polypeptide
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11505 - protein, 631 aa, Artificial Sequence
  Synthetic Polypeptide
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11506 - protein, 629 aa, Artificial Sequence
  Synthetic Polypeptide
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11507 - protein, 628 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11508 - protein, 631 aa, Artificial Sequence
  Synthetic Polypeptide
MALPVTALLLPLALLLHAARPELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11509 - protein, 625 aa, Artificial Sequence
  Synthetic Polypeptide
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11510 - protein, 632 aa, Artificial Sequence
  Synthetic Polypeptide
MALPVTALLLPLALLLHAARPDVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVILVESGGGLVKPGGSLKLSCAASGFTFSSYTMSWVRQTPEKRLEWVATISSGGGNTYYPDSVKGRFTISRDNAKNNLYLQMSSLRSEDTALYYCARYYRYEAWFASWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11511 - protein, 629 aa, Artificial Sequence; identical to SEQ ID NO: 11445
  Synthetic Polypeptide

SEQ ID NO: 11512 - protein, 630 aa, Artificial Sequence
  Synthetic Polypeptide
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11513 - protein, 628 aa, Artificial Sequence
  Synthetic Polypeptide
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11514 - protein, 629 aa, Artificial Sequence
  Synthetic Polypeptide
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11515 - protein, 625 aa, Artificial Sequence
  Synthetic Polypeptide
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11516 - protein, 627 aa, Artificial Sequence
  Synthetic Polypeptide
MALPVTALLLPLALLLHAARPDVVMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGVSLPDYGVSWIRQPPGKGLEWIGVIWGSETTYYNSALKSRVLISVDTSKNQVSLKLSSVTAADTAVYYCARHYYYGGSYAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11517 - protein, 629 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11518 - protein, 640 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11519 - protein, 633 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11520 - protein, 625 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11521 - protein, 632 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11522 - protein, 625 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11523 - protein, 633 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11524 - protein, 600 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRASRPLQRDPPCFLWLPAASLQAEEQPLWAAWSRITFPSLPCPGIAEHQAACTPFQPCCKAAACTLAAWSQCLALAWAPRPTSAMTTSLATPRWTREWNPRAVSPRTHSSQAPRAAATSWWKRASRQTPTTSRTASASSCCKWPALTCPCGCGPAAPREADLASRPISTCSWLATWNPTQALLVWTGFGASFSLSALLPARIPSNRSSWWNQGAVWCSRVGADCHAWRLASHSRTTACTGCDRPPERVWSGSPSGTTDLMSITEILREGSPSPATIAKICSTCKTHSGRMIRRSTIALAQGLLWPAHSITGDRVPWQYQARVDSLRPILPHCSLQAAKNSRPTRPHLCASPTSTLGLQWLGRPMDLLKPAWKPPSHPSRATTNTPPAPTAHLSSGSPTDPTAAKPTKAAPWKRQWPLQSAAAEPIAALPARATSRACAPPSCTRSCWARPPCTPCWCLPWCWLWSSGRTAG

SEQ ID NO: 11525 - protein, 635 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11526 - protein, 625 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWRYALDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11527 - protein, 625 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11528 - protein, 630 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11529 - protein, 635 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11530 - protein, 640 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11531 - protein, 631 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11532 - protein, 627 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11533 - protein, 628 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11534 - protein, 630 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11535 - protein, 632 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11536 - protein, 628 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11537 - protein, 625 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11538 - protein, 626 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11539 - protein, 632 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11540 - protein, 622 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11541 - protein, 622 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11542 - skipped

SEQ ID NO: 11543 - protein, 626 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11544 - protein, 627 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11545 - protein, 628 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11546 - protein, 635 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11547 - protein, 634 aa, Artificial Sequence
  Synthetic Polypeptide
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11548 - protein, 626 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFERAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11549 - protein, 636 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11550 - protein, 627 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11551 - protein, 631 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11552 - protein, 629 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11553 - protein, 629 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11554 - protein, 630 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11555 - protein, 627 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11556 - protein, 630 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11557 - protein, 754 aa, Artificial Sequence
  Synthetic Polypeptide
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11558 - protein, 630 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11559 - protein, 630 aa, Artificial Sequence; identical to SEQ ID NO: 11558
  Synthetic Polypeptide

SEQ ID NO: 11560 - protein, 630 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11561 - protein, 632 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11562 - protein, 633 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11563 - protein, 625 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11564 - protein, 631 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11565 - protein, 624 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11566 - protein, 629 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11567 - protein, 626 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11568 - protein, 636 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11569 - protein, 632 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11570 - protein, 636 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11571 - protein, 621 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11572 - protein, 630 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11573 - protein, 626 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11574 - protein, 634 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11575 - protein, 629 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11576 - protein, 624 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11577 - protein, 627 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11578 - protein, 622 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11579 - protein, 632 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11580 - protein, 624 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11581 - protein, 627 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11582 - protein, 637 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11583 - protein, 634 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11584 - protein, 626 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11585 - protein, 619 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11586 - protein, 624 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11587 - protein, 627 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11588 - protein, 632 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11589 - protein, 629 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11590 - protein, 627 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11591 - protein, 627 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11592 - protein, 633 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11593 - protein, 633 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11594 - protein, 631 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11595 - protein, 626 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11596 - protein, 621 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVELEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11597 - protein, 627 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11598 - protein, 634 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11599 - protein, 635 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11600 - protein, 632 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11601 - protein, 629 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11602 - protein, 630 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11603 - protein, 627 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11604 - protein, 625 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11605 - protein, 627 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11606 - protein, 629 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11607 - protein, 634 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11608 - protein, 628 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11609 - protein, 629 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11610 - protein, 627 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11611 - protein, 626 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11612 - protein, 627 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11613 - protein, 626 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11614 - protein, 627 aa, Artificial Sequence
  Synthetic Polypeptide
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11615 - protein, 634 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11616 - protein, 640 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11617 - protein, 625 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11618 - protein, 635 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEILEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFELEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11619 - protein, 615 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11620 - protein, 761 aa, Artificial Sequence
  Synthetic Polypeptide
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11621 - protein, 625 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11622 - protein, 629 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11623 - protein, 625 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11624 - protein, 626 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11625 - protein, 631 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11626 - protein, 625 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11627 - protein, 626 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11628 - protein, 634 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11629 - protein, 630 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11630 - protein, 627 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11631 - protein, 627 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11632 - protein, 626 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11633 - protein, 626 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11634 - protein, 630 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11635 - protein, 633 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11636 - protein, 635 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11637 - protein, 634 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQILEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11638 - protein, 624 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11639 - protein, 626 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11640 - protein, 628 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11641 - protein, 629 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11642 - protein, 625 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11643 - protein, 644 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11644 - protein, 641 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11645 - protein, 615 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11646 - protein, 631 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11647 - protein, 622 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11648 - protein, 623 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11649 - protein, 623 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11650 - protein, 634 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11651 - protein, 630 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11652 - protein, 625 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11653 - protein, 629 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11654 - protein, 638 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11655 - protein, 629 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11656 - protein, 632 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11657 - protein, 627 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11658 - protein, 628 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11659 - protein, 637 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11660 - protein, 627 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11661 - protein, 624 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11662 - protein, 629 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11663 - protein, 628 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11664 - protein, 630 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11665 - protein, 609 aa, Artificial Sequence
  Synthetic Polypeptide
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11666 - protein, 626 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11667 - protein, 624 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11668 - protein, 635 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11669 - protein, 630 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11670 - protein, 631 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11671 - protein, 630 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVQLVQSGGGVMRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11672 - protein, 643 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11673 - protein, 637 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11674 - protein, 629 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11675 - protein, 628 aa, Artificial Sequence
  Synthetic Polypeptide
MALPVTALLLPLALLLHAARPDEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11676 - protein, 629 aa, Artificial Sequence
  Synthetic Polypeptide
MALPVTALLLPLALLLHAARPDDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11677 - protein, 620 aa, Artificial Sequence
  Synthetic Polypeptide
MALPVTALLLPLALLLHAARPDDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11678 - protein, 623 aa, Artificial Sequence
  Synthetic Polypeptide
MALPVTALLLPLALLLHAARPDDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11679 - protein, 630 aa, Artificial Sequence
  Synthetic Polypeptide
MALPVTALLLPLALLLHAARPDDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11680 - protein, 626 aa, Artificial Sequence
  Synthetic Polypeptide
MALPVTALLLPLALLLHAARPDDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11681 - protein, 626 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11682 - protein, 627 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11683 - protein, 632 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11684 - protein, 628 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11685 - protein, 634 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11686 - protein, 639 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11687 - protein, 639 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFELEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11688 - protein, 629 aa, Artificial Sequence; identical to SEQ ID NO: 11553
  Synthetic Polypeptide

SEQ ID NO: 11689 - protein, 629 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11690 - protein, 633 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11691 - protein, 633 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11692 - protein, 627 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11693 - protein, 629 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11694 - protein, 626 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11695 - protein, 627 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11696 - protein, 623 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11697 - protein, 626 aa, Artificial Sequence
  Synthetic Polypeptide
MALPVTALLLPLALLLHAARPDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11698 - protein, 625 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11699 - protein, 634 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11700 - protein, 638 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11701 - protein, 633 aa, Artificial Sequence
  Synthetic Polypeptide
MALPVTALLLPLALLLHAARPDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11702 - protein, 629 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11703 - protein, 629 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11704 - protein, 632 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11705 - protein, 630 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11706 - protein, 629 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11707 - protein, 631 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11708 - protein, 628 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11709 - protein, 629 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11710 - protein, 630 aa, Artificial Sequence
  Synthetic Polypeptide
MALPVTALLLPLALLLHAARPDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11711 - protein, 629 aa, Artificial Sequence
  Synthetic Polypeptide
MALPVTALLLPLALLLHAARPDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11712 - protein, 624 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11713 - protein, 629 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11714 - protein, 628 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11715 - protein, 628 aa, Artificial Sequence; identical to SEQ ID NO: 11714
  Synthetic Polypeptide

SEQ ID NO: 11716 - protein, 625 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11717 - protein, 626 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11718 - protein, 627 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11719 - protein, 633 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11720 - protein, 631 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11721 - protein, 631 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11722 - protein, 629 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11723 - protein, 630 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11724 - protein, 630 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11725 - protein, 630 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11726 - protein, 628 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11727 - protein, 628 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11728 - protein, 630 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11729 - protein, 636 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFESVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11730 - protein, 627 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11731 - protein, 629 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11732 - protein, 631 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11733 - protein, 635 aa, Artificial Sequence
  Synthetic Polypeptide
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFELEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11734 - protein, 632 aa, Artificial Sequence
  Synthetic Polypeptide
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11735 - protein, 625 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11736 - protein, 629 aa, Artificial Sequence
  Synthetic Polypeptide
MALPVTALLLPLALLLHAARPQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11737 - protein, 630 aa, Artificial Sequence
  Synthetic Polypeptide
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFESSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11738 - protein, 639 aa, Artificial Sequence
  Synthetic Polypeptide
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11739 - protein, 617 aa, Artificial Sequence
  Synthetic Polypeptide
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11740 - protein, 639 aa, Artificial Sequence
  Synthetic Polypeptide
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11741 - protein, 638 aa, Artificial Sequence
  Synthetic Polypeptide
MALPVTALLLPLALLLHAARPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11742 - protein, 638 aa, Artificial Sequence
  Synthetic Polypeptide
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11743 - protein, 634 aa, Artificial Sequence
  Synthetic Polypeptide
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11744 - protein, 619 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11745 - protein, 638 aa, Artificial Sequence
  Synthetic Polypeptide
MALPVTALLLPLALLLHAARPLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11746 - protein, 628 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11747 - protein, 631 aa, Artificial Sequence
  Synthetic Polypeptide
MALPVTALLLPLALLLHAARPNFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11748 - protein, 623 aa, Artificial Sequence
  Synthetic Polypeptide
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11749 - protein, 631 aa, Artificial Sequence
  Synthetic Polypeptide
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11750 - protein, 629 aa, Artificial Sequence
  Synthetic Polypeptide
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11751 - protein, 628 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11752 - protein, 631 aa, Artificial Sequence
  Synthetic Polypeptide
MALPVTALLLPLALLLHAARPELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11753 - protein, 625 aa, Artificial Sequence
  Synthetic Polypeptide
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11754 - protein, 632 aa, Artificial Sequence
  Synthetic Polypeptide
MALPVTALLLPLALLLHAARPDVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVILVESGGGLVKPGGSLKLSCAASGFTFSSYTMSWVRQTPEKRLEWVATISSGGGNTYYPDSVKGRFTISRDNAKNNLYLQMSSLRSEDTALYYCARYYRYEAWFASWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11755 - protein, 629 aa, Artificial Sequence; identical to SEQ ID NO: 11689
  Synthetic Polypeptide

SEQ ID NO: 11756 - protein, 630 aa, Artificial Sequence
  Synthetic Polypeptide
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11757 - protein, 628 aa, Artificial Sequence
  Synthetic Polypeptide
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11758 - protein, 629 aa, Artificial Sequence
  Synthetic Polypeptide
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11759 - protein, 625 aa, Artificial Sequence
  Synthetic Polypeptide
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11760 - protein, 627 aa, Artificial Sequence
  Synthetic Polypeptide
MALPVTALLLPLALLLHAARPDVVMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSQTLSLTCTVSGVSLPDYGVSWIRQPPGKGLEWIGVIWGSETTYYNSALKSRVLISVDTSKNQVSLKLSSVTAADTAVYYCARHYYYGGSYAMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11761 - protein, 629 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKALEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11762 - protein, 640 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11763 - protein, 633 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11764 - protein, 625 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11765 - protein, 632 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11766 - protein, 625 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11767 - protein, 633 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11768 - protein, 601 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRASRPLQRDPPCFLWLPAASLQAEEQPLWAAWSRITFPSLPCPGIAEHQAACTPFQPCCKAAACTLAAWSQCLALAWAPRPTSAMTTSLATPRWTREWNPRAVSPRTHSSQAPRAAATSWWKRASRQTPTTSRTASASESCCKWPCLPCPCGCGPAAPREADLASRPISTCSWLATWNPTQALLVWTGFGASFSLSALLPARIPSNRSSWWNQGAVWCSRVGADCHAWRLASHSRTTACTGCDRPPERVWSGSPSGTTDLMSITEILREGSPSPATIAKICSTCKTHSGRMIRRSTIALAQGLLWPAHSITGDRVPWQYQARVDSLRPILPHCSLQAAKNSRPTRPHLCASPTSTLGLQWLGRPMDLLKPAWKPPSHPSRATTNTPPAPTAHLSSGSPTDPTAAKPTKAAPWKRQWPLQSAAAEPIAALPARATSRACAPPSCTRSCWARPPCTPCWCLPWCWLWSSGRTAG

SEQ ID NO: 11769 - protein, 635 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11770 - protein, 625 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWRYALDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11771 - protein, 625 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11772 - protein, 630 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11773 - protein, 635 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11774 - protein, 640 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11775 - protein, 631 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11776 - protein, 627 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11777 - protein, 628 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11778 - protein, 630 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11779 - protein, 632 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11780 - protein, 628 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11781 - protein, 625 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11782 - protein, 626 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11783 - protein, 632 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11784 - protein, 622 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11785 - protein, 622 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKLEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 11786 - skipped

SEQ ID NO: 11787 - protein, 8 aa, Artificial Sequence
  Synthetic Polypeptide
PAGIYAPI

SEQ ID NO: 11788 - protein, 15 aa, Artificial Sequence
  Synthetic Polypeptide
FLKMESLNFIRAHTP

SEQ ID NO: 11789 - protein, 17 aa, Artificial Sequence
  Synthetic Polypeptide
HFLKMESLNFIRAHTPY

SEQ ID NO: 11790 - protein, 18 aa, Artificial Sequence
  Synthetic Polypeptide
YNAEPANPSEKNSPSTQY

SEQ ID NO: 11791 - protein, 16 aa, Artificial Sequence
  Synthetic Polypeptide
YNAEPANPSEKNSPST

SEQ ID NO: 11792 - protein, 14 aa, Artificial Sequence
  Synthetic Polypeptide
YNCEPANPSEKNSP

SEQ ID NO: 11793 - protein, 22 aa, Artificial Sequence
  Synthetic Polypeptide
EYFDSLLHACIPCQLRCSSNTP

SEQ ID NO: 11794 - protein, 34 aa, Artificial Sequence
  Synthetic Polypeptide
CSQNEYFDSLLHACIPCQLRCSSNTPPLTCQRYC

SEQ ID NO: 11795 - protein, 41 aa, Artificial Sequence
  Synthetic Polypeptide
MLQMAGQCSQNEYFDSLLHACIPCQLRCSSNTPPLTCQRYC

SEQ ID NO: 11796 - protein, 51 aa, Artificial Sequence
  Synthetic Polypeptide
MLQMAGQCSQNEYFDSLLHACIPCQLRCSSNTPPLTCQRYCNASVTNSVKG

SEQ ID NO: 11797 - protein, 31 aa, Artificial Sequence
  Synthetic Polypeptide
TNAILWTCLGLSLIISLAVFVLMFLLRKINS

SEQ ID NO: 11798 - protein, 7 aa, Artificial Sequence
  Synthetic Polypeptide
PWQDGPK

SEQ ID NO: 11799 - skipped

SEQ ID NO: 11800 - protein, 30 aa, Artificial Sequence
  Synthetic Polypeptide
TNATTKAAGGALQSTASLFVVSLSLLHLYS

SEQ ID NO: 11801 - protein, 32 aa, Artificial Sequence
  Synthetic Polypeptide
VSQVKISGAPTLSPSLLGLLLPAFGILVYLEF

SEQ ID NO: 11802 - protein, 35 aa, Artificial Sequence
  Synthetic Polypeptide
PEVRVLHSIGHSAAPRLFPLAWTVLLLPLLLLQTP

SEQ ID NO: 11803 - protein, 35 aa, Artificial Sequence
  Synthetic Polypeptide
EAPEPIFTSNNSCSSPGGCRLFLSTIPVLWRLLGS

SEQ ID NO: 11804 - protein, 35 aa, Artificial Sequence
  Synthetic Polypeptide
QVPKLEKSISGTSPKREHLPLAVGIAFFLMTFLAS

SEQ ID NO: 11805 - protein, 35 aa, Artificial Sequence
  Synthetic Polypeptide
ESAEPSRGENAAQTPRIPSRLLAILLFLLAMLLTL

SEQ ID NO: 11806 - protein, 29 aa, Artificial Sequence
  Synthetic Polypeptide
YAAAMSGAGPWAAWPFLLSLALMLLWLLS

SEQ ID NO: 11807 - protein, 29 aa, Artificial Sequence
  Synthetic Polypeptide
SVRGINGSISLAVPLWLLAASLLCLLSKC

SEQ ID NO: 11808 - protein, 32 aa, Artificial Sequence
  Synthetic Polypeptide
TTDAAHPGRSVVPALLPLLAGTLLLLETATAP

SEQ ID NO: 11809 - protein, 31 aa, Artificial Sequence
  Synthetic Polypeptide
DSEGSGALPSLTCSLTPLGLALVLWTVLGPC

SEQ ID NO: 11810-11819 - skipped (10 entries)

SEQ ID NO: 11820 - DNA, 738 bp, Artificial Sequence
  Synthetic Polynucleotide
atggagaacgtgctgacacagagccctgccatcatgagcgcttccccaggcgagaaagtgaccatgacctgtagagccagcagcagcgtgatctccagctacctgcactggtatcagcagaagtccggcgcaagccccaagctgtggatctacagcaccagcaatctggcctccggcgtgcccgatagattttctggctctggcagcggcaccagctacagcctgacaatctctagcgtggaagccgaggatgccgccacctactactgccagcagtacaacggctaccctctgacctttggagccggcaccaagctggaaatcaaaggcggaggcggaagtggaggcggaggatctggcggcggaggctctcaagttcagctgcaacagagcggagccgagctggttaagcctggcgcttctgtgaagatgagctgcaaagccttcggctacaccttcaccacctatcctatcgagtggatgaagcagaaccacggcaagagcctggaatggatcggcaactttcacccctacaacgacgacaccaagtacaacgagaagttcaagggcaaagccaagctgaccgtggaaaagtccagcaccaccgtgtacctggaactgagcagactgaccagcgacgacagcgccgtgtactactgcgccagagagaattacggcagccacggcggctttgtgtattggggccagggaacactggtcaccgtgagctctacgcgt

SEQ ID NO: 11821 - DNA, 744 bp, Artificial Sequence
  Synthetic Polynucleotide
atggagaacgtgctgacacagagccctgccatcatgagcgcttccccaggcgagaaagtgaccatgacctgtagagccagcagcagcgtgatctccagctacctgcactggtatcagcagaagtccggcgcaagccccaagctgtggatctacagcaccagcaatctggcctccggcgtgcccgatagattttctggctctggcagcggcaccagctacagcctgacaatctctagcgtggaagccgaggatgccgccacctactactgccagcagtacaacggctaccctctgacctttggagccggcaccaagctggaaatcaaaggcggaggcggaagtggaggcggaggatctggcggcggaggctctcaagttcagctgcaacagagcggagccgagctggttaagcctggcgcttctgtgaagatgagctgcaaagccttcggctacaccttcaccacctatcctatcgagtggatgaagcagaaccacggcaagagcctggaatggatcggcaactttcacccctacaacgacgacaccaagtacaacgagaagttcaagggcaaagccaagctgaccgtggaaaagtccagcaccaccgtgtacctggaactgagcagactgaccagcgacgacagcgccgtgtactactgcgccagagagaattacggcagccacggcggctttgtgtattggggccagggaacactggtcaccgtgagctctaaggatgagctg

SEQ ID NO: 11822 - DNA, 750 bp, Artificial Sequence
  Synthetic Polynucleotide
atggagaacgtgctgacacagagccctgccatcatgagcgcttccccaggcgagaaagtgaccatgacctgtagagccagcagcagcgtgatctccagctacctgcactggtatcagcagaagtccggcgcaagccccaagctgtggatctacagcaccagcaatctggcctccggcgtgcccgatagattttctggctctggcagcggcaccagctacagcctgacaatctctagcgtggaagccgaggatgccgccacctactactgccagcagtacaacggctaccctctgacctttggagccggcaccaagctggaaatcaaaggcggaggcggaagtggaggcggaggatctggcggcggaggctctcaagttcagctgcaacagagcggagccgagctggttaagcctggcgcttctgtgaagatgagctgcaaagccttcggctacaccttcaccacctatcctatcgagtggatgaagcagaaccacggcaagagcctggaatggatcggcaactttcacccctacaacgacgacaccaagtacaacgagaagttcaagggcaaagccaagctgaccgtggaaaagtccagcaccaccgtgtacctggaactgagcagactgaccagcgacgacagcgccgtgtactactgcgccagagagaattacggcagccacggcggctttgtgtattggggccagggaacactggtcaccgtgagctctcaccatcaccatcatcac

SEQ ID NO: 11823 - DNA, 1071 bp, Artificial Sequence
  Synthetic Polynucleotide
atggagaacgtgctgacacagagccctgccatcatgagcgcttccccaggcgagaaagtgaccatgacctgtagagccagcagcagcgtgatctccagctacctgcactggtatcagcagaagtccggcgcaagccccaagctgtggatctacagcaccagcaatctggcctccggcgtgcccgatagattttctggctctggcagcggcaccagctacagcctgacaatctctagcgtggaagccgaggatgccgccacctactactgccagcagtacaacggctaccctctgacctttggagccggcaccaagctggaaatcaaaggcggaggcggaagtggaggcggaggatctggcggcggaggctctcaagttcagctgcaacagagcggagccgagctggttaagcctggcgcttctgtgaagatgagctgcaaagccttcggctacaccttcaccacctatcctatcgagtggatgaagcagaaccacggcaagagcctggaatggatcggcaactttcacccctacaacgacgacaccaagtacaacgagaagttcaagggcaaagccaagctgaccgtggaaaagtccagcaccaccgtgtacctggaactgagcagactgaccagcgacgacagcgccgtgtactactgcgccagagagaattacggcagccacggcggctttgtgtattggggccagggaacactggtcaccgtgagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 11824 - DNA, 1071 bp, Artificial Sequence
  Synthetic Polynucleotide
atggagaacgtgctgacacagagccctgccatcatgagcgcttccccaggcgagaaagtgaccatgacctgtagagccagcagcagcgtgatctccagctacctgcactggtatcagcagaagtccggcgcaagccccaagctgtggatctacagcaccagcaatctggcctccggcgtgcccgatagattttctggctctggcagcggcaccagctacagcctgacaatctctagcgtggaagccgaggatgccgccacctactactgccagcagtacaacggctaccctctgacctttggagccggcaccaagctggaaatcaaaggcggaggcggaagtggaggcggaggatctggcggcggaggctctcaagttcagctgcaacagagcggagccgagctggttaagcctggcgcttctgtgaagatgagctgcaaagccttcggctacaccttcaccacctatcctatcgagtggatgaagcagaaccacggcaagagcctggaatggatcggcaactttcacccctacaacgacgacaccaagtacaacgagaagttcaagggcaaagccaagctgaccgtggaaaagtccagcaccaccgtgtacctggaactgagcagactgaccagcgacgacagcgccgtgtactactgcgccagagagaattacggcagccacggcggctttgtgtattggggccagggaacactggtcaccgtgagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 11825 - DNA, 1476 bp, Artificial Sequence
  Synthetic Polynucleotide
atggccttaccagtgaccgccttgctcctgccgctggccttgctgctccacgccgccaggccggagaacgtgctgacacagagccctgccatcatgagcgcttccccaggcgagaaagtgaccatgacctgtagagccagcagcagcgtgatctccagctacctgcactggtatcagcagaagtccggcgcaagccccaagctgtggatctacagcaccagcaatctggcctccggcgtgcccgatagattttctggctctggcagcggcaccagctacagcctgacaatctctagcgtggaagccgaggatgccgccacctactactgccagcagtacaacggctaccctctgacctttggagccggcaccaagctggaaatcaaaggcggaggcggaagtggaggcggaggatctggcggcggaggctctcaagttcagctgcaacagagcggagccgagctggttaagcctggcgcttctgtgaagatgagctgcaaagccttcggctacaccttcaccacctatcctatcgagtggatgaagcagaaccacggcaagagcctggaatggatcggcaactttcacccctacaacgacgacaccaagtacaacgagaagttcaagggcaaagccaagctgaccgtggaaaagtccagcaccaccgtgtacctggaactgagcagactgaccagcgacgacagcgccgtgtactactgcgccagagagaattacggcagccacggcggctttgtgtattggggccagggaacactggtcaccgtgagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 11826 - DNA, 1032 bp, Artificial Sequence
  Synthetic Polynucleotide
atggccttaccagtgaccgccttgctcctgccgctggccttgctgctccacgccgccaggccggagaacgtgctgacacagagccctgccatcatgagcgcttccccaggcgagaaagtgaccatgacctgtagagccagcagcagcgtgatctccagctacctgcactggtatcagcagaagtccggcgcaagccccaagctgtggatctacagcaccagcaatctggcctccggcgtgcccgatagattttctggctctggcagcggcaccagctacagcctgacaatctctagcgtggaagccgaggatgccgccacctactactgccagcagtacaacggctaccctctgacctttggagccggcaccaagctggaaatcaaaggcggaggcggaagtggaggcggaggatctggcggcggaggctctcaagttcagctgcaacagagcggagccgagctggttaagcctggcgcttctgtgaagatgagctgcaaagccttcggctacaccttcaccacctatcctatcgagtggatgaagcagaaccacggcaagagcctggaatggatcggcaactttcacccctacaacgacgacaccaagtacaacgagaagttcaagggcaaagccaagctgaccgtggaaaagtccagcaccaccgtgtacctggaactgagcagactgaccagcgacgacagcgccgtgtactactgcgccagagagaattacggcagccacggcggctttgtgtattggggccagggaacactggtcaccgtgagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11827 - DNA, 1032 bp, Artificial Sequence
  Synthetic Polynucleotide
atggccttaccagtgaccgccttgctcctgccgctggccttgctgctccacgccgccaggccggagaacgtgctgacacagagccctgccatcatgagcgcttccccaggcgagaaagtgaccatgacctgtagagccagcagcagcgtgatctccagctacctgcactggtatcagcagaagtccggcgcaagccccaagctgtggatctacagcaccagcaatctggcctccggcgtgcccgatagattttctggctctggcagcggcaccagctacagcctgacaatctctagcgtggaagccgaggatgccgccacctactactgccagcagtacaacggctaccctctgacctttggagccggcaccaagctggaaatcaaaggcggaggcggaagtggaggcggaggatctggcggcggaggctctcaagttcagctgcaacagagcggagccgagctggttaagcctggcgcttctgtgaagatgagctgcaaagccttcggctacaccttcaccacctatcctatcgagtggatgaagcagaaccacggcaagagcctggaatggatcggcaactttcacccctacaacgacgacaccaagtacaacgagaagttcaagggcaaagccaagctgaccgtggaaaagtccagcaccaccgtgtacctggaactgagcagactgaccagcgacgacagcgccgtgtactactgcgccagagagaattacggcagccacggcggctttgtgtattggggccagggaacactggtcaccgtgagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 11828 - DNA, 1341 bp, Artificial Sequence
  Synthetic Polynucleotide
atggccttaccagtgaccgccttgctcctgccgctggccttgctgctccacgccgccaggccggagaacgtgctgacacagagccctgccatcatgagcgcttccccaggcgagaaagtgaccatgacctgtagagccagcagcagcgtgatctccagctacctgcactggtatcagcagaagtccggcgcaagccccaagctgtggatctacagcaccagcaatctggcctccggcgtgcccgatagattttctggctctggcagcggcaccagctacagcctgacaatctctagcgtggaagccgaggatgccgccacctactactgccagcagtacaacggctaccctctgacctttggagccggcaccaagctggaaatcaaaggcggaggcggaagtggaggcggaggatctggcggcggaggctctcaagttcagctgcaacagagcggagccgagctggttaagcctggcgcttctgtgaagatgagctgcaaagccttcggctacaccttcaccacctatcctatcgagtggatgaagcagaaccacggcaagagcctggaatggatcggcaactttcacccctacaacgacgacaccaagtacaacgagaagttcaagggcaaagccaagctgaccgtggaaaagtccagcaccaccgtgtacctggaactgagcagactgaccagcgacgacagcgccgtgtactactgcgccagagagaattacggcagccacggcggctttgtgtattggggccagggaacactggtcaccgtgagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 11829 - DNA, 1341 bp, Artificial Sequence
  Synthetic Polynucleotide
atggccttaccagtgaccgccttgctcctgccgctggccttgctgctccacgccgccaggccggagaacgtgctgacacagagccctgccatcatgagcgcttccccaggcgagaaagtgaccatgacctgtagagccagcagcagcgtgatctccagctacctgcactggtatcagcagaagtccggcgcaagccccaagctgtggatctacagcaccagcaatctggcctccggcgtgcccgatagattttctggctctggcagcggcaccagctacagcctgacaatctctagcgtggaagccgaggatgccgccacctactactgccagcagtacaacggctaccctctgacctttggagccggcaccaagctggaaatcaaaggcggaggcggaagtggaggcggaggatctggcggcggaggctctcaagttcagctgcaacagagcggagccgagctggttaagcctggcgcttctgtgaagatgagctgcaaagccttcggctacaccttcaccacctatcctatcgagtggatgaagcagaaccacggcaagagcctggaatggatcggcaactttcacccctacaacgacgacaccaagtacaacgagaagttcaagggcaaagccaagctgaccgtggaaaagtccagcaccaccgtgtacctggaactgagcagactgaccagcgacgacagcgccgtgtactactgcgccagagagaattacggcagccacggcggctttgtgtattggggccagggaacactggtcaccgtgagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaa

SEQ ID NO: 11830 - DNA, 1011 bp, Artificial Sequence
  Synthetic Polynucleotide
atggccttaccagtgaccgccttgctcctgccgctggccttgctgctccacgccgccaggccggagaacgtgctgacacagagccctgccatcatgagcgcttccccaggcgagaaagtgaccatgacctgtagagccagcagcagcgtgatctccagctacctgcactggtatcagcagaagtccggcgcaagccccaagctgtggatctacagcaccagcaatctggcctccggcgtgcccgatagattttctggctctggcagcggcaccagctacagcctgacaatctctagcgtggaagccgaggatgccgccacctactactgccagcagtacaacggctaccctctgacctttggagccggcaccaagctggaaatcaaaggcggaggcggaagtggaggcggaggatctggcggcggaggctctcaagttcagctgcaacagagcggagccgagctggttaagcctggcgcttctgtgaagatgagctgcaaagccttcggctacaccttcaccacctatcctatcgagtggatgaagcagaaccacggcaagagcctggaatggatcggcaactttcacccctacaacgacgacaccaagtacaacgagaagttcaagggcaaagccaagctgaccgtggaaaagtccagcaccaccgtgtacctggaactgagcagactgaccagcgacgacagcgccgtgtactactgcgccagagagaattacggcagccacggcggctttgtgtattggggccagggaacactggtcaccgtgagctctacgcgtattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagc

SEQ ID NO: 11831 - DNA, 1338 bp, Artificial Sequence
  Synthetic Polynucleotide
atggccttaccagtgaccgccttgctcctgccgctggccttgctgctccacgccgccaggccggagaacgtgctgacacagagccctgccatcatgagcgcttccccaggcgagaaagtgaccatgacctgtagagccagcagcagcgtgatctccagctacctgcactggtatcagcagaagtccggcgcaagccccaagctgtggatctacagcaccagcaatctggcctccggcgtgcccgatagattttctggctctggcagcggcaccagctacagcctgacaatctctagcgtggaagccgaggatgccgccacctactactgccagcagtacaacggctaccctctgacctttggagccggcaccaagctggaaatcaaaggcggaggcggaagtggaggcggaggatctggcggcggaggctctcaagttcagctgcaacagagcggagccgagctggttaagcctggcgcttctgtgaagatgagctgcaaagccttcggctacaccttcaccacctatcctatcgagtggatgaagcagaaccacggcaagagcctggaatggatcggcaactttcacccctacaacgacgacaccaagtacaacgagaagttcaagggcaaagccaagctgaccgtggaaaagtccagcaccaccgtgtacctggaactgagcagactgaccagcgacgacagcgccgtgtactactgcgccagagagaattacggcagccacggcggctttgtgtattggggccagggaacactggtcaccgtgagctctacgcgtattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcggaggcggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 11832 - DNA, 1338 bp, Artificial Sequence
  Synthetic Polynucleotide
atggccttaccagtgaccgccttgctcctgccgctggccttgctgctccacgccgccaggccggagaacgtgctgacacagagccctgccatcatgagcgcttccccaggcgagaaagtgaccatgacctgtagagccagcagcagcgtgatctccagctacctgcactggtatcagcagaagtccggcgcaagccccaagctgtggatctacagcaccagcaatctggcctccggcgtgcccgatagattttctggctctggcagcggcaccagctacagcctgacaatctctagcgtggaagccgaggatgccgccacctactactgccagcagtacaacggctaccctctgacctttggagccggcaccaagctggaaatcaaaggcggaggcggaagtggaggcggaggatctggcggcggaggctctcaagttcagctgcaacagagcggagccgagctggttaagcctggcgcttctgtgaagatgagctgcaaagccttcggctacaccttcaccacctatcctatcgagtggatgaagcagaaccacggcaagagcctggaatggatcggcaactttcacccctacaacgacgacaccaagtacaacgagaagttcaagggcaaagccaagctgaccgtggaaaagtccagcaccaccgtgtacctggaactgagcagactgaccagcgacgacagcgccgtgtactactgcgccagagagaattacggcagccacggcggctttgtgtattggggccagggaacactggtcaccgtgagctctacgcgtattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcggaggcggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaa

SEQ ID NO: 11833 - DNA, 918 bp, Artificial Sequence
  Synthetic Polynucleotide
atggccttaccagtgaccgccttgctcctgccgctggccttgctgctccacgccgccaggccggagaacgtgctgacacagagccctgccatcatgagcgcttccccaggcgagaaagtgaccatgacctgtagagccagcagcagcgtgatctccagctacctgcactggtatcagcagaagtccggcgcaagccccaagctgtggatctacagcaccagcaatctggcctccggcgtgcccgatagattttctggctctggcagcggcaccagctacagcctgacaatctctagcgtggaagccgaggatgccgccacctactactgccagcagtacaacggctaccctctgacctttggagccggcaccaagctggaaatcaaaggcggaggcggaagtggaggcggaggatctggcggcggaggctctcaagttcagctgcaacagagcggagccgagctggttaagcctggcgcttctgtgaagatgagctgcaaagccttcggctacaccttcaccacctatcctatcgagtggatgaagcagaaccacggcaagagcctggaatggatcggcaactttcacccctacaacgacgacaccaagtacaacgagaagttcaagggcaaagccaagctgaccgtggaaaagtccagcaccaccgtgtacctggaactgagcagactgaccagcgacgacagcgccgtgtactactgcgccagagagaattacggcagccacggcggctttgtgtattggggccagggaacactggtcaccgtgagctctacgcgtgcggcggggggcgcagtgcacacgagggggctggacttcgcctgtgacatctacatctgggcgcccttggccgggacttgtggggtccttctcctgtcactggttatcaccctttactgc

SEQ ID NO: 11834 - skipped

SEQ ID NO: 11835 - DNA, 738 bp, Artificial Sequence
  Synthetic Polynucleotide
atggagaacgtgatgacacagagcccctttagcctgagcgccagcgtgggagacagagtgaccatcacatgtagagccagcagcagcgtgatctccagctacctgcactggtatcagcagaagcccgccaaggctcccaagctgttcatctacagcaccagcaatctggcctccggcgtgccaagcagattttctggctctggcagcggcaccgactacaccctgacaatatctagcctccagcctgaggacttcgccacctactactgccagcagtacaacagctaccctctgacctttggcggaggcaccaaggtggaaatcaaaggcggaggcggaagtggaggcggaggatctggcggcggaggctctgaagtgcagctggtgcagtctggggccgaagtgaagaaacctggcagctccgtgaaggtgtcctgcaaagccttcggctacacctttaccacctatcctatcgagtggatgcggcaggcccacggacaaggactggaatggatcggcaactttcacccctacaacgacgacaccaagtacaacgagaagttcaagggccgcgtgacaatcaccgccgacaagtctacaagcaccgcctacatggaactgagcagcctgagaagcgaggacaccgccgtgtactactgcgccagagagaattacggcagccacggcggctttgtgtattggggacagggcacactggtcaccgtgtctagtacgcgt

SEQ ID NO: 11836 - DNA, 744 bp, Artificial Sequence
  Synthetic Polynucleotide
atggagaacgtgatgacacagagcccctttagcctgagcgccagcgtgggagacagagtgaccatcacatgtagagccagcagcagcgtgatctccagctacctgcactggtatcagcagaagcccgccaaggctcccaagctgttcatctacagcaccagcaatctggcctccggcgtgccaagcagattttctggctctggcagcggcaccgactacaccctgacaatatctagcctccagcctgaggacttcgccacctactactgccagcagtacaacagctaccctctgacctttggcggaggcaccaaggtggaaatcaaaggcggaggcggaagtggaggcggaggatctggcggcggaggctctgaagtgcagctggtgcagtctggggccgaagtgaagaaacctggcagctccgtgaaggtgtcctgcaaagccttcggctacacctttaccacctatcctatcgagtggatgcggcaggcccacggacaaggactggaatggatcggcaactttcacccctacaacgacgacaccaagtacaacgagaagttcaagggccgcgtgacaatcaccgccgacaagtctacaagcaccgcctacatggaactgagcagcctgagaagcgaggacaccgccgtgtactactgcgccagagagaattacggcagccacggcggctttgtgtattggggacagggcacactggtcaccgtgtctagtaaggatgagctg

SEQ ID NO: 11837 - DNA, 750 bp, Artificial Sequence
  Synthetic Polynucleotide
atggagaacgtgatgacacagagcccctttagcctgagcgccagcgtgggagacagagtgaccatcacatgtagagccagcagcagcgtgatctccagctacctgcactggtatcagcagaagcccgccaaggctcccaagctgttcatctacagcaccagcaatctggcctccggcgtgccaagcagattttctggctctggcagcggcaccgactacaccctgacaatatctagcctccagcctgaggacttcgccacctactactgccagcagtacaacagctaccctctgacctttggcggaggcaccaaggtggaaatcaaaggcggaggcggaagtggaggcggaggatctggcggcggaggctctgaagtgcagctggtgcagtctggggccgaagtgaagaaacctggcagctccgtgaaggtgtcctgcaaagccttcggctacacctttaccacctatcctatcgagtggatgcggcaggcccacggacaaggactggaatggatcggcaactttcacccctacaacgacgacaccaagtacaacgagaagttcaagggccgcgtgacaatcaccgccgacaagtctacaagcaccgcctacatggaactgagcagcctgagaagcgaggacaccgccgtgtactactgcgccagagagaattacggcagccacggcggctttgtgtattggggacagggcacactggtcaccgtgtctagtcaccatcaccatcatcac

SEQ ID NO: 11838 - DNA, 1071 bp, Artificial Sequence
  Synthetic Polynucleotide
atggagaacgtgatgacacagagcccctttagcctgagcgccagcgtgggagacagagtgaccatcacatgtagagccagcagcagcgtgatctccagctacctgcactggtatcagcagaagcccgccaaggctcccaagctgttcatctacagcaccagcaatctggcctccggcgtgccaagcagattttctggctctggcagcggcaccgactacaccctgacaatatctagcctccagcctgaggacttcgccacctactactgccagcagtacaacagctaccctctgacctttggcggaggcaccaaggtggaaatcaaaggcggaggcggaagtggaggcggaggatctggcggcggaggctctgaagtgcagctggtgcagtctggggccgaagtgaagaaacctggcagctccgtgaaggtgtcctgcaaagccttcggctacacctttaccacctatcctatcgagtggatgcggcaggcccacggacaaggactggaatggatcggcaactttcacccctacaacgacgacaccaagtacaacgagaagttcaagggccgcgtgacaatcaccgccgacaagtctacaagcaccgcctacatggaactgagcagcctgagaagcgaggacaccgccgtgtactactgcgccagagagaattacggcagccacggcggctttgtgtattggggacagggcacactggtcaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 11839 - DNA, 1071 bp, Artificial Sequence
  Synthetic Polynucleotide
atggagaacgtgatgacacagagcccctttagcctgagcgccagcgtgggagacagagtgaccatcacatgtagagccagcagcagcgtgatctccagctacctgcactggtatcagcagaagcccgccaaggctcccaagctgttcatctacagcaccagcaatctggcctccggcgtgccaagcagattttctggctctggcagcggcaccgactacaccctgacaatatctagcctccagcctgaggacttcgccacctactactgccagcagtacaacagctaccctctgacctttggcggaggcaccaaggtggaaatcaaaggcggaggcggaagtggaggcggaggatctggcggcggaggctctgaagtgcagctggtgcagtctggggccgaagtgaagaaacctggcagctccgtgaaggtgtcctgcaaagccttcggctacacctttaccacctatcctatcgagtggatgcggcaggcccacggacaaggactggaatggatcggcaactttcacccctacaacgacgacaccaagtacaacgagaagttcaagggccgcgtgacaatcaccgccgacaagtctacaagcaccgcctacatggaactgagcagcctgagaagcgaggacaccgccgtgtactactgcgccagagagaattacggcagccacggcggctttgtgtattggggacagggcacactggtcaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 11840 - DNA, 1476 bp, Artificial Sequence
  Synthetic Polynucleotide
atggccttaccagtgaccgccttgctcctgccgctggccttgctgctccacgccgccaggccggagaacgtgatgacacagagcccctttagcctgagcgccagcgtgggagacagagtgaccatcacatgtagagccagcagcagcgtgatctccagctacctgcactggtatcagcagaagcccgccaaggctcccaagctgttcatctacagcaccagcaatctggcctccggcgtgccaagcagattttctggctctggcagcggcaccgactacaccctgacaatatctagcctccagcctgaggacttcgccacctactactgccagcagtacaacagctaccctctgacctttggcggaggcaccaaggtggaaatcaaaggcggaggcggaagtggaggcggaggatctggcggcggaggctctgaagtgcagctggtgcagtctggggccgaagtgaagaaacctggcagctccgtgaaggtgtcctgcaaagccttcggctacacctttaccacctatcctatcgagtggatgcggcaggcccacggacaaggactggaatggatcggcaactttcacccctacaacgacgacaccaagtacaacgagaagttcaagggccgcgtgacaatcaccgccgacaagtctacaagcaccgcctacatggaactgagcagcctgagaagcgaggacaccgccgtgtactactgcgccagagagaattacggcagccacggcggctttgtgtattggggacagggcacactggtcaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 11841 - DNA, 1032 bp, Artificial Sequence
  Synthetic Polynucleotide
atggccttaccagtgaccgccttgctcctgccgctggccttgctgctccacgccgccaggccggagaacgtgatgacacagagcccctttagcctgagcgccagcgtgggagacagagtgaccatcacatgtagagccagcagcagcgtgatctccagctacctgcactggtatcagcagaagcccgccaaggctcccaagctgttcatctacagcaccagcaatctggcctccggcgtgccaagcagattttctggctctggcagcggcaccgactacaccctgacaatatctagcctccagcctgaggacttcgccacctactactgccagcagtacaacagctaccctctgacctttggcggaggcaccaaggtggaaatcaaaggcggaggcggaagtggaggcggaggatctggcggcggaggctctgaagtgcagctggtgcagtctggggccgaagtgaagaaacctggcagctccgtgaaggtgtcctgcaaagccttcggctacacctttaccacctatcctatcgagtggatgcggcaggcccacggacaaggactggaatggatcggcaactttcacccctacaacgacgacaccaagtacaacgagaagttcaagggccgcgtgacaatcaccgccgacaagtctacaagcaccgcctacatggaactgagcagcctgagaagcgaggacaccgccgtgtactactgcgccagagagaattacggcagccacggcggctttgtgtattggggacagggcacactggtcaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11842 - DNA, 1032 bp, Artificial Sequence
  Synthetic Polynucleotide
atggccttaccagtgaccgccttgctcctgccgctggccttgctgctccacgccgccaggccggagaacgtgatgacacagagcccctttagcctgagcgccagcgtgggagacagagtgaccatcacatgtagagccagcagcagcgtgatctccagctacctgcactggtatcagcagaagcccgccaaggctcccaagctgttcatctacagcaccagcaatctggcctccggcgtgccaagcagattttctggctctggcagcggcaccgactacaccctgacaatatctagcctccagcctgaggacttcgccacctactactgccagcagtacaacagctaccctctgacctttggcggaggcaccaaggtggaaatcaaaggcggaggcggaagtggaggcggaggatctggcggcggaggctctgaagtgcagctggtgcagtctggggccgaagtgaagaaacctggcagctccgtgaaggtgtcctgcaaagccttcggctacacctttaccacctatcctatcgagtggatgcggcaggcccacggacaaggactggaatggatcggcaactttcacccctacaacgacgacaccaagtacaacgagaagttcaagggccgcgtgacaatcaccgccgacaagtctacaagcaccgcctacatggaactgagcagcctgagaagcgaggacaccgccgtgtactactgcgccagagagaattacggcagccacggcggctttgtgtattggggacagggcacactggtcaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 11843 - DNA, 1341 bp, Artificial Sequence
  Synthetic Polynucleotide
atggccttaccagtgaccgccttgctcctgccgctggccttgctgctccacgccgccaggccggagaacgtgatgacacagagcccctttagcctgagcgccagcgtgggagacagagtgaccatcacatgtagagccagcagcagcgtgatctccagctacctgcactggtatcagcagaagcccgccaaggctcccaagctgttcatctacagcaccagcaatctggcctccggcgtgccaagcagattttctggctctggcagcggcaccgactacaccctgacaatatctagcctccagcctgaggacttcgccacctactactgccagcagtacaacagctaccctctgacctttggcggaggcaccaaggtggaaatcaaaggcggaggcggaagtggaggcggaggatctggcggcggaggctctgaagtgcagctggtgcagtctggggccgaagtgaagaaacctggcagctccgtgaaggtgtcctgcaaagccttcggctacacctttaccacctatcctatcgagtggatgcggcaggcccacggacaaggactggaatggatcggcaactttcacccctacaacgacgacaccaagtacaacgagaagttcaagggccgcgtgacaatcaccgccgacaagtctacaagcaccgcctacatggaactgagcagcctgagaagcgaggacaccgccgtgtactactgcgccagagagaattacggcagccacggcggctttgtgtattggggacagggcacactggtcaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 11844 - DNA, 1341 bp, Artificial Sequence
  Synthetic Polynucleotide
atggccttaccagtgaccgccttgctcctgccgctggccttgctgctccacgccgccaggccggagaacgtgatgacacagagcccctttagcctgagcgccagcgtgggagacagagtgaccatcacatgtagagccagcagcagcgtgatctccagctacctgcactggtatcagcagaagcccgccaaggctcccaagctgttcatctacagcaccagcaatctggcctccggcgtgccaagcagattttctggctctggcagcggcaccgactacaccctgacaatatctagcctccagcctgaggacttcgccacctactactgccagcagtacaacagctaccctctgacctttggcggaggcaccaaggtggaaatcaaaggcggaggcggaagtggaggcggaggatctggcggcggaggctctgaagtgcagctggtgcagtctggggccgaagtgaagaaacctggcagctccgtgaaggtgtcctgcaaagccttcggctacacctttaccacctatcctatcgagtggatgcggcaggcccacggacaaggactggaatggatcggcaactttcacccctacaacgacgacaccaagtacaacgagaagttcaagggccgcgtgacaatcaccgccgacaagtctacaagcaccgcctacatggaactgagcagcctgagaagcgaggacaccgccgtgtactactgcgccagagagaattacggcagccacggcggctttgtgtattggggacagggcacactggtcaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaa

SEQ ID NO: 11845 - DNA, 1011 bp, Artificial Sequence
  Synthetic Polynucleotide
atggccttaccagtgaccgccttgctcctgccgctggccttgctgctccacgccgccaggccggagaacgtgatgacacagagcccctttagcctgagcgccagcgtgggagacagagtgaccatcacatgtagagccagcagcagcgtgatctccagctacctgcactggtatcagcagaagcccgccaaggctcccaagctgttcatctacagcaccagcaatctggcctccggcgtgccaagcagattttctggctctggcagcggcaccgactacaccctgacaatatctagcctccagcctgaggacttcgccacctactactgccagcagtacaacagctaccctctgacctttggcggaggcaccaaggtggaaatcaaaggcggaggcggaagtggaggcggaggatctggcggcggaggctctgaagtgcagctggtgcagtctggggccgaagtgaagaaacctggcagctccgtgaaggtgtcctgcaaagccttcggctacacctttaccacctatcctatcgagtggatgcggcaggcccacggacaaggactggaatggatcggcaactttcacccctacaacgacgacaccaagtacaacgagaagttcaagggccgcgtgacaatcaccgccgacaagtctacaagcaccgcctacatggaactgagcagcctgagaagcgaggacaccgccgtgtactactgcgccagagagaattacggcagccacggcggctttgtgtattggggacagggcacactggtcaccgtgtctagtacgcgtattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagc

SEQ ID NO: 11846 - DNA, 1338 bp, Artificial Sequence
  Synthetic Polynucleotide
atggccttaccagtgaccgccttgctcctgccgctggccttgctgctccacgccgccaggccggagaacgtgatgacacagagcccctttagcctgagcgccagcgtgggagacagagtgaccatcacatgtagagccagcagcagcgtgatctccagctacctgcactggtatcagcagaagcccgccaaggctcccaagctgttcatctacagcaccagcaatctggcctccggcgtgccaagcagattttctggctctggcagcggcaccgactacaccctgacaatatctagcctccagcctgaggacttcgccacctactactgccagcagtacaacagctaccctctgacctttggcggaggcaccaaggtggaaatcaaaggcggaggcggaagtggaggcggaggatctggcggcggaggctctgaagtgcagctggtgcagtctggggccgaagtgaagaaacctggcagctccgtgaaggtgtcctgcaaagccttcggctacacctttaccacctatcctatcgagtggatgcggcaggcccacggacaaggactggaatggatcggcaactttcacccctacaacgacgacaccaagtacaacgagaagttcaagggccgcgtgacaatcaccgccgacaagtctacaagcaccgcctacatggaactgagcagcctgagaagcgaggacaccgccgtgtactactgcgccagagagaattacggcagccacggcggctttgtgtattggggacagggcacactggtcaccgtgtctagtacgcgtattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcggaggcggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 11847 - DNA, 1338 bp, Artificial Sequence
  Synthetic Polynucleotide
atggccttaccagtgaccgccttgctcctgccgctggccttgctgctccacgccgccaggccggagaacgtgatgacacagagcccctttagcctgagcgccagcgtgggagacagagtgaccatcacatgtagagccagcagcagcgtgatctccagctacctgcactggtatcagcagaagcccgccaaggctcccaagctgttcatctacagcaccagcaatctggcctccggcgtgccaagcagattttctggctctggcagcggcaccgactacaccctgacaatatctagcctccagcctgaggacttcgccacctactactgccagcagtacaacagctaccctctgacctttggcggaggcaccaaggtggaaatcaaaggcggaggcggaagtggaggcggaggatctggcggcggaggctctgaagtgcagctggtgcagtctggggccgaagtgaagaaacctggcagctccgtgaaggtgtcctgcaaagccttcggctacacctttaccacctatcctatcgagtggatgcggcaggcccacggacaaggactggaatggatcggcaactttcacccctacaacgacgacaccaagtacaacgagaagttcaagggccgcgtgacaatcaccgccgacaagtctacaagcaccgcctacatggaactgagcagcctgagaagcgaggacaccgccgtgtactactgcgccagagagaattacggcagccacggcggctttgtgtattggggacagggcacactggtcaccgtgtctagtacgcgtattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcggaggcggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaa

SEQ ID NO: 11848 - DNA, 918 bp, Artificial Sequence
  Synthetic Polynucleotide
atggccttaccagtgaccgccttgctcctgccgctggccttgctgctccacgccgccaggccggagaacgtgatgacacagagcccctttagcctgagcgccagcgtgggagacagagtgaccatcacatgtagagccagcagcagcgtgatctccagctacctgcactggtatcagcagaagcccgccaaggctcccaagctgttcatctacagcaccagcaatctggcctccggcgtgccaagcagattttctggctctggcagcggcaccgactacaccctgacaatatctagcctccagcctgaggacttcgccacctactactgccagcagtacaacagctaccctctgacctttggcggaggcaccaaggtggaaatcaaaggcggaggcggaagtggaggcggaggatctggcggcggaggctctgaagtgcagctggtgcagtctggggccgaagtgaagaaacctggcagctccgtgaaggtgtcctgcaaagccttcggctacacctttaccacctatcctatcgagtggatgcggcaggcccacggacaaggactggaatggatcggcaactttcacccctacaacgacgacaccaagtacaacgagaagttcaagggccgcgtgacaatcaccgccgacaagtctacaagcaccgcctacatggaactgagcagcctgagaagcgaggacaccgccgtgtactactgcgccagagagaattacggcagccacggcggctttgtgtattggggacagggcacactggtcaccgtgtctagtacgcgtgcggcggggggcgcagtgcacacgagggggctggacttcgcctgtgacatctacatctgggcgcccttggccgggacttgtggggtccttctcctgtcactggttatcaccctttactgc

SEQ ID NO: 11849 - skipped

SEQ ID NO: 11850 - DNA, 768 bp, Artificial Sequence
  Synthetic Polynucleotide
atgaacttcatgctgacccagcctcacagcgtgtccgagtctccaggcaagaccgtgaccatcagctgcacaagaagcagcggctctatcgccagcaacagcgtgcagtggtatcagcagaggccaggcagcagccctaccaccgtgatctacgaggataaccagaggccaagcggcgtgcccgatagattttctggcagcatcgacagcagcagcaactccgcctctctgacagtgtccggcctgaaaacagaggacgaggccgactactactgccagagcagcgattctagcgccgtggtgtttggcagcggcaccaaactgacagtgcttggcggaggcggaagtggaggcggaggatctggcggcggaggctctcaagttcagctgcaagaatctggccctggcgtggtcaagcctagcggaacactgtctctgacctgtgccatctctggcggcagcattggtagcggcggatctatcagatccaccagatggtggtcctgggtccgacagtctcctggcaaaggactggaatggatcggcgaaatctaccacagcggcagcaccaactacaaccccagcctgaagtccagagtgacaatcagcctggacaagtcccggaaccacttcagcctgagactgaactctgtgacagccgccgataccgccgtgtactactgtgccagacaggactacggcgacagcggcgactggtactttgatctgtggggcaagggcacaatggtcaccgtgtcatctacgcgt

SEQ ID NO: 11851 - DNA, 774 bp, Artificial Sequence
  Synthetic Polynucleotide
atgaacttcatgctgacccagcctcacagcgtgtccgagtctccaggcaagaccgtgaccatcagctgcacaagaagcagcggctctatcgccagcaacagcgtgcagtggtatcagcagaggccaggcagcagccctaccaccgtgatctacgaggataaccagaggccaagcggcgtgcccgatagattttctggcagcatcgacagcagcagcaactccgcctctctgacagtgtccggcctgaaaacagaggacgaggccgactactactgccagagcagcgattctagcgccgtggtgtttggcagcggcaccaaactgacagtgcttggcggaggcggaagtggaggcggaggatctggcggcggaggctctcaagttcagctgcaagaatctggccctggcgtggtcaagcctagcggaacactgtctctgacctgtgccatctctggcggcagcattggtagcggcggatctatcagatccaccagatggtggtcctgggtccgacagtctcctggcaaaggactggaatggatcggcgaaatctaccacagcggcagcaccaactacaaccccagcctgaagtccagagtgacaatcagcctggacaagtcccggaaccacttcagcctgagactgaactctgtgacagccgccgataccgccgtgtactactgtgccagacaggactacggcgacagcggcgactggtactttgatctgtggggcaagggcacaatggtcaccgtgtcatctaaggatgagctg

SEQ ID NO: 11852 - DNA, 780 bp, Artificial Sequence
  Synthetic Polynucleotide
atgaacttcatgctgacccagcctcacagcgtgtccgagtctccaggcaagaccgtgaccatcagctgcacaagaagcagcggctctatcgccagcaacagcgtgcagtggtatcagcagaggccaggcagcagccctaccaccgtgatctacgaggataaccagaggccaagcggcgtgcccgatagattttctggcagcatcgacagcagcagcaactccgcctctctgacagtgtccggcctgaaaacagaggacgaggccgactactactgccagagcagcgattctagcgccgtggtgtttggcagcggcaccaaactgacagtgcttggcggaggcggaagtggaggcggaggatctggcggcggaggctctcaagttcagctgcaagaatctggccctggcgtggtcaagcctagcggaacactgtctctgacctgtgccatctctggcggcagcattggtagcggcggatctatcagatccaccagatggtggtcctgggtccgacagtctcctggcaaaggactggaatggatcggcgaaatctaccacagcggcagcaccaactacaaccccagcctgaagtccagagtgacaatcagcctggacaagtcccggaaccacttcagcctgagactgaactctgtgacagccgccgataccgccgtgtactactgtgccagacaggactacggcgacagcggcgactggtactttgatctgtggggcaagggcacaatggtcaccgtgtcatctcaccatcaccatcatcac

SEQ ID NO: 11853 - DNA, 1101 bp, Artificial Sequence
  Synthetic Polynucleotide
atgaacttcatgctgacccagcctcacagcgtgtccgagtctccaggcaagaccgtgaccatcagctgcacaagaagcagcggctctatcgccagcaacagcgtgcagtggtatcagcagaggccaggcagcagccctaccaccgtgatctacgaggataaccagaggccaagcggcgtgcccgatagattttctggcagcatcgacagcagcagcaactccgcctctctgacagtgtccggcctgaaaacagaggacgaggccgactactactgccagagcagcgattctagcgccgtggtgtttggcagcggcaccaaactgacagtgcttggcggaggcggaagtggaggcggaggatctggcggcggaggctctcaagttcagctgcaagaatctggccctggcgtggtcaagcctagcggaacactgtctctgacctgtgccatctctggcggcagcattggtagcggcggatctatcagatccaccagatggtggtcctgggtccgacagtctcctggcaaaggactggaatggatcggcgaaatctaccacagcggcagcaccaactacaaccccagcctgaagtccagagtgacaatcagcctggacaagtcccggaaccacttcagcctgagactgaactctgtgacagccgccgataccgccgtgtactactgtgccagacaggactacggcgacagcggcgactggtactttgatctgtggggcaagggcacaatggtcaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 11854 - DNA, 1101 bp, Artificial Sequence
  Synthetic Polynucleotide
atgaacttcatgctgacccagcctcacagcgtgtccgagtctccaggcaagaccgtgaccatcagctgcacaagaagcagcggctctatcgccagcaacagcgtgcagtggtatcagcagaggccaggcagcagccctaccaccgtgatctacgaggataaccagaggccaagcggcgtgcccgatagattttctggcagcatcgacagcagcagcaactccgcctctctgacagtgtccggcctgaaaacagaggacgaggccgactactactgccagagcagcgattctagcgccgtggtgtttggcagcggcaccaaactgacagtgcttggcggaggcggaagtggaggcggaggatctggcggcggaggctctcaagttcagctgcaagaatctggccctggcgtggtcaagcctagcggaacactgtctctgacctgtgccatctctggcggcagcattggtagcggcggatctatcagatccaccagatggtggtcctgggtccgacagtctcctggcaaaggactggaatggatcggcgaaatctaccacagcggcagcaccaactacaaccccagcctgaagtccagagtgacaatcagcctggacaagtcccggaaccacttcagcctgagactgaactctgtgacagccgccgataccgccgtgtactactgtgccagacaggactacggcgacagcggcgactggtactttgatctgtggggcaagggcacaatggtcaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 11855 - DNA, 1506 bp, Artificial Sequence
  Synthetic Polynucleotide
atggccttaccagtgaccgccttgctcctgccgctggccttgctgctccacgccgccaggccgaacttcatgctgacccagcctcacagcgtgtccgagtctccaggcaagaccgtgaccatcagctgcacaagaagcagcggctctatcgccagcaacagcgtgcagtggtatcagcagaggccaggcagcagccctaccaccgtgatctacgaggataaccagaggccaagcggcgtgcccgatagattttctggcagcatcgacagcagcagcaactccgcctctctgacagtgtccggcctgaaaacagaggacgaggccgactactactgccagagcagcgattctagcgccgtggtgtttggcagcggcaccaaactgacagtgcttggcggaggcggaagtggaggcggaggatctggcggcggaggctctcaagttcagctgcaagaatctggccctggcgtggtcaagcctagcggaacactgtctctgacctgtgccatctctggcggcagcattggtagcggcggatctatcagatccaccagatggtggtcctgggtccgacagtctcctggcaaaggactggaatggatcggcgaaatctaccacagcggcagcaccaactacaaccccagcctgaagtccagagtgacaatcagcctggacaagtcccggaaccacttcagcctgagactgaactctgtgacagccgccgataccgccgtgtactactgtgccagacaggactacggcgacagcggcgactggtactttgatctgtggggcaagggcacaatggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 11856 - DNA, 1062 bp, Artificial Sequence
  Synthetic Polynucleotide
atggccttaccagtgaccgccttgctcctgccgctggccttgctgctccacgccgccaggccgaacttcatgctgacccagcctcacagcgtgtccgagtctccaggcaagaccgtgaccatcagctgcacaagaagcagcggctctatcgccagcaacagcgtgcagtggtatcagcagaggccaggcagcagccctaccaccgtgatctacgaggataaccagaggccaagcggcgtgcccgatagattttctggcagcatcgacagcagcagcaactccgcctctctgacagtgtccggcctgaaaacagaggacgaggccgactactactgccagagcagcgattctagcgccgtggtgtttggcagcggcaccaaactgacagtgcttggcggaggcggaagtggaggcggaggatctggcggcggaggctctcaagttcagctgcaagaatctggccctggcgtggtcaagcctagcggaacactgtctctgacctgtgccatctctggcggcagcattggtagcggcggatctatcagatccaccagatggtggtcctgggtccgacagtctcctggcaaaggactggaatggatcggcgaaatctaccacagcggcagcaccaactacaaccccagcctgaagtccagagtgacaatcagcctggacaagtcccggaaccacttcagcctgagactgaactctgtgacagccgccgataccgccgtgtactactgtgccagacaggactacggcgacagcggcgactggtactttgatctgtggggcaagggcacaatggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11857 - DNA, 1062 bp, Artificial Sequence
  Synthetic Polynucleotide
atggccttaccagtgaccgccttgctcctgccgctggccttgctgctccacgccgccaggccgaacttcatgctgacccagcctcacagcgtgtccgagtctccaggcaagaccgtgaccatcagctgcacaagaagcagcggctctatcgccagcaacagcgtgcagtggtatcagcagaggccaggcagcagccctaccaccgtgatctacgaggataaccagaggccaagcggcgtgcccgatagattttctggcagcatcgacagcagcagcaactccgcctctctgacagtgtccggcctgaaaacagaggacgaggccgactactactgccagagcagcgattctagcgccgtggtgtttggcagcggcaccaaactgacagtgcttggcggaggcggaagtggaggcggaggatctggcggcggaggctctcaagttcagctgcaagaatctggccctggcgtggtcaagcctagcggaacactgtctctgacctgtgccatctctggcggcagcattggtagcggcggatctatcagatccaccagatggtggtcctgggtccgacagtctcctggcaaaggactggaatggatcggcgaaatctaccacagcggcagcaccaactacaaccccagcctgaagtccagagtgacaatcagcctggacaagtcccggaaccacttcagcctgagactgaactctgtgacagccgccgataccgccgtgtactactgtgccagacaggactacggcgacagcggcgactggtactttgatctgtggggcaagggcacaatggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 11858 - DNA, 1371 bp, Artificial Sequence
  Synthetic Polynucleotide
atggccttaccagtgaccgccttgctcctgccgctggccttgctgctccacgccgccaggccgaacttcatgctgacccagcctcacagcgtgtccgagtctccaggcaagaccgtgaccatcagctgcacaagaagcagcggctctatcgccagcaacagcgtgcagtggtatcagcagaggccaggcagcagccctaccaccgtgatctacgaggataaccagaggccaagcggcgtgcccgatagattttctggcagcatcgacagcagcagcaactccgcctctctgacagtgtccggcctgaaaacagaggacgaggccgactactactgccagagcagcgattctagcgccgtggtgtttggcagcggcaccaaactgacagtgcttggcggaggcggaagtggaggcggaggatctggcggcggaggctctcaagttcagctgcaagaatctggccctggcgtggtcaagcctagcggaacactgtctctgacctgtgccatctctggcggcagcattggtagcggcggatctatcagatccaccagatggtggtcctgggtccgacagtctcctggcaaaggactggaatggatcggcgaaatctaccacagcggcagcaccaactacaaccccagcctgaagtccagagtgacaatcagcctggacaagtcccggaaccacttcagcctgagactgaactctgtgacagccgccgataccgccgtgtactactgtgccagacaggactacggcgacagcggcgactggtactttgatctgtggggcaagggcacaatggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 11859 - DNA, 1371 bp, Artificial Sequence
  Synthetic Polynucleotide
atggccttaccagtgaccgccttgctcctgccgctggccttgctgctccacgccgccaggccgaacttcatgctgacccagcctcacagcgtgtccgagtctccaggcaagaccgtgaccatcagctgcacaagaagcagcggctctatcgccagcaacagcgtgcagtggtatcagcagaggccaggcagcagccctaccaccgtgatctacgaggataaccagaggccaagcggcgtgcccgatagattttctggcagcatcgacagcagcagcaactccgcctctctgacagtgtccggcctgaaaacagaggacgaggccgactactactgccagagcagcgattctagcgccgtggtgtttggcagcggcaccaaactgacagtgcttggcggaggcggaagtggaggcggaggatctggcggcggaggctctcaagttcagctgcaagaatctggccctggcgtggtcaagcctagcggaacactgtctctgacctgtgccatctctggcggcagcattggtagcggcggatctatcagatccaccagatggtggtcctgggtccgacagtctcctggcaaaggactggaatggatcggcgaaatctaccacagcggcagcaccaactacaaccccagcctgaagtccagagtgacaatcagcctggacaagtcccggaaccacttcagcctgagactgaactctgtgacagccgccgataccgccgtgtactactgtgccagacaggactacggcgacagcggcgactggtactttgatctgtggggcaagggcacaatggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaa

SEQ ID NO: 11860 - DNA, 1041 bp, Artificial Sequence
  Synthetic Polynucleotide
atggccttaccagtgaccgccttgctcctgccgctggccttgctgctccacgccgccaggccgaacttcatgctgacccagcctcacagcgtgtccgagtctccaggcaagaccgtgaccatcagctgcacaagaagcagcggctctatcgccagcaacagcgtgcagtggtatcagcagaggccaggcagcagccctaccaccgtgatctacgaggataaccagaggccaagcggcgtgcccgatagattttctggcagcatcgacagcagcagcaactccgcctctctgacagtgtccggcctgaaaacagaggacgaggccgactactactgccagagcagcgattctagcgccgtggtgtttggcagcggcaccaaactgacagtgcttggcggaggcggaagtggaggcggaggatctggcggcggaggctctcaagttcagctgcaagaatctggccctggcgtggtcaagcctagcggaacactgtctctgacctgtgccatctctggcggcagcattggtagcggcggatctatcagatccaccagatggtggtcctgggtccgacagtctcctggcaaaggactggaatggatcggcgaaatctaccacagcggcagcaccaactacaaccccagcctgaagtccagagtgacaatcagcctggacaagtcccggaaccacttcagcctgagactgaactctgtgacagccgccgataccgccgtgtactactgtgccagacaggactacggcgacagcggcgactggtactttgatctgtggggcaagggcacaatggtcaccgtgtcatctacgcgtattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagc

SEQ ID NO: 11861 - DNA, 1368 bp, Artificial Sequence
  Synthetic Polynucleotide
atggccttaccagtgaccgccttgctcctgccgctggccttgctgctccacgccgccaggccgaacttcatgctgacccagcctcacagcgtgtccgagtctccaggcaagaccgtgaccatcagctgcacaagaagcagcggctctatcgccagcaacagcgtgcagtggtatcagcagaggccaggcagcagccctaccaccgtgatctacgaggataaccagaggccaagcggcgtgcccgatagattttctggcagcatcgacagcagcagcaactccgcctctctgacagtgtccggcctgaaaacagaggacgaggccgactactactgccagagcagcgattctagcgccgtggtgtttggcagcggcaccaaactgacagtgcttggcggaggcggaagtggaggcggaggatctggcggcggaggctctcaagttcagctgcaagaatctggccctggcgtggtcaagcctagcggaacactgtctctgacctgtgccatctctggcggcagcattggtagcggcggatctatcagatccaccagatggtggtcctgggtccgacagtctcctggcaaaggactggaatggatcggcgaaatctaccacagcggcagcaccaactacaaccccagcctgaagtccagagtgacaatcagcctggacaagtcccggaaccacttcagcctgagactgaactctgtgacagccgccgataccgccgtgtactactgtgccagacaggactacggcgacagcggcgactggtactttgatctgtggggcaagggcacaatggtcaccgtgtcatctacgcgtattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcggaggcggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 11862 - DNA, 1368 bp, Artificial Sequence
  Synthetic Polynucleotide
atggccttaccagtgaccgccttgctcctgccgctggccttgctgctccacgccgccaggccgaacttcatgctgacccagcctcacagcgtgtccgagtctccaggcaagaccgtgaccatcagctgcacaagaagcagcggctctatcgccagcaacagcgtgcagtggtatcagcagaggccaggcagcagccctaccaccgtgatctacgaggataaccagaggccaagcggcgtgcccgatagattttctggcagcatcgacagcagcagcaactccgcctctctgacagtgtccggcctgaaaacagaggacgaggccgactactactgccagagcagcgattctagcgccgtggtgtttggcagcggcaccaaactgacagtgcttggcggaggcggaagtggaggcggaggatctggcggcggaggctctcaagttcagctgcaagaatctggccctggcgtggtcaagcctagcggaacactgtctctgacctgtgccatctctggcggcagcattggtagcggcggatctatcagatccaccagatggtggtcctgggtccgacagtctcctggcaaaggactggaatggatcggcgaaatctaccacagcggcagcaccaactacaaccccagcctgaagtccagagtgacaatcagcctggacaagtcccggaaccacttcagcctgagactgaactctgtgacagccgccgataccgccgtgtactactgtgccagacaggactacggcgacagcggcgactggtactttgatctgtggggcaagggcacaatggtcaccgtgtcatctacgcgtattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcggaggcggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaa

SEQ ID NO: 11863 - DNA, 948 bp, Artificial Sequence
  Synthetic Polynucleotide
atggccttaccagtgaccgccttgctcctgccgctggccttgctgctccacgccgccaggccgaacttcatgctgacccagcctcacagcgtgtccgagtctccaggcaagaccgtgaccatcagctgcacaagaagcagcggctctatcgccagcaacagcgtgcagtggtatcagcagaggccaggcagcagccctaccaccgtgatctacgaggataaccagaggccaagcggcgtgcccgatagattttctggcagcatcgacagcagcagcaactccgcctctctgacagtgtccggcctgaaaacagaggacgaggccgactactactgccagagcagcgattctagcgccgtggtgtttggcagcggcaccaaactgacagtgcttggcggaggcggaagtggaggcggaggatctggcggcggaggctctcaagttcagctgcaagaatctggccctggcgtggtcaagcctagcggaacactgtctctgacctgtgccatctctggcggcagcattggtagcggcggatctatcagatccaccagatggtggtcctgggtccgacagtctcctggcaaaggactggaatggatcggcgaaatctaccacagcggcagcaccaactacaaccccagcctgaagtccagagtgacaatcagcctggacaagtcccggaaccacttcagcctgagactgaactctgtgacagccgccgataccgccgtgtactactgtgccagacaggactacggcgacagcggcgactggtactttgatctgtggggcaagggcacaatggtcaccgtgtcatctacgcgtgcggcggggggcgcagtgcacacgagggggctggacttcgcctgtgacatctacatctgggcgcccttggccgggacttgtggggtccttctcctgtcactggttatcaccctttactgc

SEQ ID NO: 11864 - skipped

SEQ ID NO: 11865 - protein, 246 aa, Artificial Sequence
  Synthetic Polypeptide
MENVLTQSPAIMSASPGEKVTMTCRASSSVISSYLHWYQQKSGASPKLWIYSTSNLASGVPDRFSGSGSGTSYSLTISSVEAEDAATYYCQQYNGYPLTFGAGTKLEIKGGGGSGGGGSGGGGSQVQLQQSGAELVKPGASVKMSCKAFGYTFTTYPIEWMKQNHGKSLEWIGNFHPYNDDTKYNEKFKGKAKLTVEKSSTTVYLELSRLTSDDSAVYYCARENYGSHGGFVYWGQGTLVTVSSTR

SEQ ID NO: 11866 - protein, 248 aa, Artificial Sequence
  Synthetic Polypeptide
MENVLTQSPAIMSASPGEKVTMTCRASSSVISSYLHWYQQKSGASPKLWIYSTSNLASGVPDRFSGSGSGTSYSLTISSVEAEDAATYYCQQYNGYPLTFGAGTKLEIKGGGGSGGGGSGGGGSQVQLQQSGAELVKPGASVKMSCKAFGYTFTTYPIEWMKQNHGKSLEWIGNFHPYNDDTKYNEKFKGKAKLTVEKSSTTVYLELSRLTSDDSAVYYCARENYGSHGGFVYWGQGTLVTVSSKDEL

SEQ ID NO: 11867 - protein, 250 aa, Artificial Sequence
  Synthetic Polypeptide
MENVLTQSPAIMSASPGEKVTMTCRASSSVISSYLHWYQQKSGASPKLWIYSTSNLASGVPDRFSGSGSGTSYSLTISSVEAEDAATYYCQQYNGYPLTFGAGTKLEIKGGGGSGGGGSGGGGSQVQLQQSGAELVKPGASVKMSCKAFGYTFTTYPIEWMKQNHGKSLEWIGNFHPYNDDTKYNEKFKGKAKLTVEKSSTTVYLELSRLTSDDSAVYYCARENYGSHGGFVYWGQGTLVTVSSHHHHHH

SEQ ID NO: 11868 - protein, 357 aa, Artificial Sequence
  Synthetic Polypeptide
MENVLTQSPAIMSASPGEKVTMTCRASSSVISSYLHWYQQKSGASPKLWIYSTSNLASGVPDRFSGSGSGTSYSLTISSVEAEDAATYYCQQYNGYPLTFGAGTKLEIKGGGGSGGGGSGGGGSQVQLQQSGAELVKPGASVKMSCKAFGYTFTTYPIEWMKQNHGKSLEWIGNFHPYNDDTKYNEKFKGKAKLTVEKSSTTVYLELSRLTSDDSAVYYCARENYGSHGGFVYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 11869 - protein, 357 aa, Artificial Sequence
  Synthetic Polypeptide
MENVLTQSPAIMSASPGEKVTMTCRASSSVISSYLHWYQQKSGASPKLWIYSTSNLASGVPDRFSGSGSGTSYSLTISSVEAEDAATYYCQQYNGYPLTFGAGTKLEIKGGGGSGGGGSGGGGSQVQLQQSGAELVKPGASVKMSCKAFGYTFTTYPIEWMKQNHGKSLEWIGNFHPYNDDTKYNEKFKGKAKLTVEKSSTTVYLELSRLTSDDSAVYYCARENYGSHGGFVYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 11870 - protein, 492 aa, Artificial Sequence
  Synthetic Polypeptide
MALPVTALLLPLALLLHAARPENVLTQSPAIMSASPGEKVTMTCRASSSVISSYLHWYQQKSGASPKLWIYSTSNLASGVPDRFSGSGSGTSYSLTISSVEAEDAATYYCQQYNGYPLTFGAGTKLEIKGGGGSGGGGSGGGGSQVQLQQSGAELVKPGASVKMSCKAFGYTFTTYPIEWMKQNHGKSLEWIGNFHPYNDDTKYNEKFKGKAKLTVEKSSTTVYLELSRLTSDDSAVYYCARENYGSHGGFVYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11871 - protein, 344 aa, Artificial Sequence
  Synthetic Polypeptide
MALPVTALLLPLALLLHAARPENVLTQSPAIMSASPGEKVTMTCRASSSVISSYLHWYQQKSGASPKLWIYSTSNLASGVPDRFSGSGSGTSYSLTISSVEAEDAATYYCQQYNGYPLTFGAGTKLEIKGGGGSGGGGSGGGGSQVQLQQSGAELVKPGASVKMSCKAFGYTFTTYPIEWMKQNHGKSLEWIGNFHPYNDDTKYNEKFKGKAKLTVEKSSTTVYLELSRLTSDDSAVYYCARENYGSHGGFVYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 11872 - protein, 344 aa, Artificial Sequence
  Synthetic Polypeptide
MALPVTALLLPLALLLHAARPENVLTQSPAIMSASPGEKVTMTCRASSSVISSYLHWYQQKSGASPKLWIYSTSNLASGVPDRFSGSGSGTSYSLTISSVEAEDAATYYCQQYNGYPLTFGAGTKLEIKGGGGSGGGGSGGGGSQVQLQQSGAELVKPGASVKMSCKAFGYTFTTYPIEWMKQNHGKSLEWIGNFHPYNDDTKYNEKFKGKAKLTVEKSSTTVYLELSRLTSDDSAVYYCARENYGSHGGFVYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 11873 - protein, 447 aa, Artificial Sequence
  Synthetic Polypeptide
MALPVTALLLPLALLLHAARPENVLTQSPAIMSASPGEKVTMTCRASSSVISSYLHWYQQKSGASPKLWIYSTSNLASGVPDRFSGSGSGTSYSLTISSVEAEDAATYYCQQYNGYPLTFGAGTKLEIKGGGGSGGGGSGGGGSQVQLQQSGAELVKPGASVKMSCKAFGYTFTTYPIEWMKQNHGKSLEWIGNFHPYNDDTKYNEKFKGKAKLTVEKSSTTVYLELSRLTSDDSAVYYCARENYGSHGGFVYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 11874 - protein, 447 aa, Artificial Sequence
  Synthetic Polypeptide
MALPVTALLLPLALLLHAARPENVLTQSPAIMSASPGEKVTMTCRASSSVISSYLHWYQQKSGASPKLWIYSTSNLASGVPDRFSGSGSGTSYSLTISSVEAEDAATYYCQQYNGYPLTFGAGTKLEIKGGGGSGGGGSGGGGSQVQLQQSGAELVKPGASVKMSCKAFGYTFTTYPIEWMKQNHGKSLEWIGNFHPYNDDTKYNEKFKGKAKLTVEKSSTTVYLELSRLTSDDSAVYYCARENYGSHGGFVYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 11875 - protein, 337 aa, Artificial Sequence
  Synthetic Polypeptide
MALPVTALLLPLALLLHAARPENVLTQSPAIMSASPGEKVTMTCRASSSVISSYLHWYQQKSGASPKLWIYSTSNLASGVPDRFSGSGSGTSYSLTISSVEAEDAATYYCQQYNGYPLTFGAGTKLEIKGGGGSGGGGSGGGGSQVQLQQSGAELVKPGASVKMSCKAFGYTFTTYPIEWMKQNHGKSLEWIGNFHPYNDDTKYNEKFKGKAKLTVEKSSTTVYLELSRLTSDDSAVYYCARENYGSHGGFVYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 11876 - protein, 446 aa, Artificial Sequence
  Synthetic Polypeptide
MALPVTALLLPLALLLHAARPENVLTQSPAIMSASPGEKVTMTCRASSSVISSYLHWYQQKSGASPKLWIYSTSNLASGVPDRFSGSGSGTSYSLTISSVEAEDAATYYCQQYNGYPLTFGAGTKLEIKGGGGSGGGGSGGGGSQVQLQQSGAELVKPGASVKMSCKAFGYTFTTYPIEWMKQNHGKSLEWIGNFHPYNDDTKYNEKFKGKAKLTVEKSSTTVYLELSRLTSDDSAVYYCARENYGSHGGFVYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 11877 - protein, 446 aa, Artificial Sequence
  Synthetic Polypeptide
MALPVTALLLPLALLLHAARPENVLTQSPAIMSASPGEKVTMTCRASSSVISSYLHWYQQKSGASPKLWIYSTSNLASGVPDRFSGSGSGTSYSLTISSVEAEDAATYYCQQYNGYPLTFGAGTKLEIKGGGGSGGGGSGGGGSQVQLQQSGAELVKPGASVKMSCKAFGYTFTTYPIEWMKQNHGKSLEWIGNFHPYNDDTKYNEKFKGKAKLTVEKSSTTVYLELSRLTSDDSAVYYCARENYGSHGGFVYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 11878 - protein, 306 aa, Artificial Sequence
  Synthetic Polypeptide
MALPVTALLLPLALLLHAARPENVLTQSPAIMSASPGEKVTMTCRASSSVISSYLHWYQQKSGASPKLWIYSTSNLASGVPDRFSGSGSGTSYSLTISSVEAEDAATYYCQQYNGYPLTFGAGTKLEIKGGGGSGGGGSGGGGSQVQLQQSGAELVKPGASVKMSCKAFGYTFTTYPIEWMKQNHGKSLEWIGNFHPYNDDTKYNEKFKGKAKLTVEKSSTTVYLELSRLTSDDSAVYYCARENYGSHGGFVYWGQGTLVTVSSTRAAGGAVHTRGLDFACDIYIWAPLAGTCGVLLLSLVITLYC

SEQ ID NO: 11879 - skipped

SEQ ID NO: 11880 - protein, 246 aa, Artificial Sequence
  Synthetic Polypeptide
MENVMTQSPFSLSASVGDRVTITCRASSSVISSYLHWYQQKPAKAPKLFIYSTSNLASGVPSRFSGSGSGTDYTLTISSLQPEDFATYYCQQYNSYPLTFGGGTKVEIKGGGGSGGGGSGGGGSEVQLVQSGAEVKKPGSSVKVSCKAFGYTFTTYPIEWMRQAHGQGLEWIGNFHPYNDDTKYNEKFKGRVTITADKSTSTAYMELSSLRSEDTAVYYCARENYGSHGGFVYWGQGTLVTVSSTR

SEQ ID NO: 11881 - protein, 248 aa, Artificial Sequence
  Synthetic Polypeptide
MENVMTQSPFSLSASVGDRVTITCRASSSVISSYLHWYQQKPAKAPKLFIYSTSNLASGVPSRFSGSGSGTDYTLTISSLQPEDFATYYCQQYNSYPLTFGGGTKVEIKGGGGSGGGGSGGGGSEVQLVQSGAEVKKPGSSVKVSCKAFGYTFTTYPIEWMRQAHGQGLEWIGNFHPYNDDTKYNEKFKGRVTITADKSTSTAYMELSSLRSEDTAVYYCARENYGSHGGFVYWGQGTLVTVSSKDEL

SEQ ID NO: 11882 - protein, 250 aa, Artificial Sequence
  Synthetic Polypeptide
MENVMTQSPFSLSASVGDRVTITCRASSSVISSYLHWYQQKPAKAPKLFIYSTSNLASGVPSRFSGSGSGTDYTLTISSLQPEDFATYYCQQYNSYPLTFGGGTKVEIKGGGGSGGGGSGGGGSEVQLVQSGAEVKKPGSSVKVSCKAFGYTFTTYPIEWMRQAHGQGLEWIGNFHPYNDDTKYNEKFKGRVTITADKSTSTAYMELSSLRSEDTAVYYCARENYGSHGGFVYWGQGTLVTVSSHHHHHH

SEQ ID NO: 11883 - protein, 357 aa, Artificial Sequence
  Synthetic Polypeptide
MENVMTQSPFSLSASVGDRVTITCRASSSVISSYLHWYQQKPAKAPKLFIYSTSNLASGVPSRFSGSGSGTDYTLTISSLQPEDFATYYCQQYNSYPLTFGGGTKVEIKGGGGSGGGGSGGGGSEVQLVQSGAEVKKPGSSVKVSCKAFGYTFTTYPIEWMRQAHGQGLEWIGNFHPYNDDTKYNEKFKGRVTITADKSTSTAYMELSSLRSEDTAVYYCARENYGSHGGFVYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 11884 - protein, 357 aa, Artificial Sequence
  Synthetic Polypeptide
MENVMTQSPFSLSASVGDRVTITCRASSSVISSYLHWYQQKPAKAPKLFIYSTSNLASGVPSRFSGSGSGTDYTLTISSLQPEDFATYYCQQYNSYPLTFGGGTKVEIKGGGGSGGGGSGGGGSEVQLVQSGAEVKKPGSSVKVSCKAFGYTFTTYPIEWMRQAHGQGLEWIGNFHPYNDDTKYNEKFKGRVTITADKSTSTAYMELSSLRSEDTAVYYCARENYGSHGGFVYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 11885 - protein, 492 aa, Artificial Sequence
  Synthetic Polypeptide
MALPVTALLLPLALLLHAARPENVMTQSPFSLSASVGDRVTITCRASSSVISSYLHWYQQKPAKAPKLFIYSTSNLASGVPSRFSGSGSGTDYTLTISSLQPEDFATYYCQQYNSYPLTFGGGTKVEIKGGGGSGGGGSGGGGSEVQLVQSGAEVKKPGSSVKVSCKAFGYTFTTYPIEWMRQAHGQGLEWIGNFHPYNDDTKYNEKFKGRVTITADKSTSTAYMELSSLRSEDTAVYYCARENYGSHGGFVYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11886 - protein, 344 aa, Artificial Sequence
  Synthetic Polypeptide
MALPVTALLLPLALLLHAARPENVMTQSPFSLSASVGDRVTITCRASSSVISSYLHWYQQKPAKAPKLFIYSTSNLASGVPSRFSGSGSGTDYTLTISSLQPEDFATYYCQQYNSYPLTFGGGTKVEIKGGGGSGGGGSGGGGSEVQLVQSGAEVKKPGSSVKVSCKAFGYTFTTYPIEWMRQAHGQGLEWIGNFHPYNDDTKYNEKFKGRVTITADKSTSTAYMELSSLRSEDTAVYYCARENYGSHGGFVYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 11887 - protein, 344 aa, Artificial Sequence
  Synthetic Polypeptide
MALPVTALLLPLALLLHAARPENVMTQSPFSLSASVGDRVTITCRASSSVISSYLHWYQQKPAKAPKLFIYSTSNLASGVPSRFSGSGSGTDYTLTISSLQPEDFATYYCQQYNSYPLTFGGGTKVEIKGGGGSGGGGSGGGGSEVQLVQSGAEVKKPGSSVKVSCKAFGYTFTTYPIEWMRQAHGQGLEWIGNFHPYNDDTKYNEKFKGRVTITADKSTSTAYMELSSLRSEDTAVYYCARENYGSHGGFVYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 11888 - protein, 447 aa, Artificial Sequence
  Synthetic Polypeptide
MALPVTALLLPLALLLHAARPENVMTQSPFSLSASVGDRVTITCRASSSVISSYLHWYQQKPAKAPKLFIYSTSNLASGVPSRFSGSGSGTDYTLTISSLQPEDFATYYCQQYNSYPLTFGGGTKVEIKGGGGSGGGGSGGGGSEVQLVQSGAEVKKPGSSVKVSCKAFGYTFTTYPIEWMRQAHGQGLEWIGNFHPYNDDTKYNEKFKGRVTITADKSTSTAYMELSSLRSEDTAVYYCARENYGSHGGFVYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 11889 - protein, 447 aa, Artificial Sequence
  Synthetic Polypeptide
MALPVTALLLPLALLLHAARPENVMTQSPFSLSASVGDRVTITCRASSSVISSYLHWYQQKPAKAPKLFIYSTSNLASGVPSRFSGSGSGTDYTLTISSLQPEDFATYYCQQYNSYPLTFGGGTKVEIKGGGGSGGGGSGGGGSEVQLVQSGAEVKKPGSSVKVSCKAFGYTFTTYPIEWMRQAHGQGLEWIGNFHPYNDDTKYNEKFKGRVTITADKSTSTAYMELSSLRSEDTAVYYCARENYGSHGGFVYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 11890 - protein, 337 aa, Artificial Sequence
  Synthetic Polypeptide
MALPVTALLLPLALLLHAARPENVMTQSPFSLSASVGDRVTITCRASSSVISSYLHWYQQKPAKAPKLFIYSTSNLASGVPSRFSGSGSGTDYTLTISSLQPEDFATYYCQQYNSYPLTFGGGTKVEIKGGGGSGGGGSGGGGSEVQLVQSGAEVKKPGSSVKVSCKAFGYTFTTYPIEWMRQAHGQGLEWIGNFHPYNDDTKYNEKFKGRVTITADKSTSTAYMELSSLRSEDTAVYYCARENYGSHGGFVYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 11891 - protein, 446 aa, Artificial Sequence
  Synthetic Polypeptide
MALPVTALLLPLALLLHAARPENVMTQSPFSLSASVGDRVTITCRASSSVISSYLHWYQQKPAKAPKLFIYSTSNLASGVPSRFSGSGSGTDYTLTISSLQPEDFATYYCQQYNSYPLTFGGGTKVEIKGGGGSGGGGSGGGGSEVQLVQSGAEVKKPGSSVKVSCKAFGYTFTTYPIEWMRQAHGQGLEWIGNFHPYNDDTKYNEKFKGRVTITADKSTSTAYMELSSLRSEDTAVYYCARENYGSHGGFVYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 11892 - protein, 446 aa, Artificial Sequence
  Synthetic Polypeptide
MALPVTALLLPLALLLHAARPENVMTQSPFSLSASVGDRVTITCRASSSVISSYLHWYQQKPAKAPKLFIYSTSNLASGVPSRFSGSGSGTDYTLTISSLQPEDFATYYCQQYNSYPLTFGGGTKVEIKGGGGSGGGGSGGGGSEVQLVQSGAEVKKPGSSVKVSCKAFGYTFTTYPIEWMRQAHGQGLEWIGNFHPYNDDTKYNEKFKGRVTITADKSTSTAYMELSSLRSEDTAVYYCARENYGSHGGFVYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 11893 - protein, 306 aa, Artificial Sequence
  Synthetic Polypeptide
MALPVTALLLPLALLLHAARPENVMTQSPFSLSASVGDRVTITCRASSSVISSYLHWYQQKPAKAPKLFIYSTSNLASGVPSRFSGSGSGTDYTLTISSLQPEDFATYYCQQYNSYPLTFGGGTKVEIKGGGGSGGGGSGGGGSEVQLVQSGAEVKKPGSSVKVSCKAFGYTFTTYPIEWMRQAHGQGLEWIGNFHPYNDDTKYNEKFKGRVTITADKSTSTAYMELSSLRSEDTAVYYCARENYGSHGGFVYWGQGTLVTVSSTRAAGGAVHTRGLDFACDIYIWAPLAGTCGVLLLSLVITLYC

SEQ ID NO: 11894 - skipped

SEQ ID NO: 11895 - protein, 256 aa, Artificial Sequence
  Synthetic Polypeptide
MNFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVLGGGGSGGGGSGGGGSQVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSSTR

SEQ ID NO: 11896 - protein, 258 aa, Artificial Sequence
  Synthetic Polypeptide
MNFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVLGGGGSGGGGSGGGGSQVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSSKDEL

SEQ ID NO: 11897 - protein, 260 aa, Artificial Sequence
  Synthetic Polypeptide
MNFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVLGGGGSGGGGSGGGGSQVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSSHHHHHH

SEQ ID NO: 11898 - protein, 367 aa, Artificial Sequence
  Synthetic Polypeptide
MNFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVLGGGGSGGGGSGGGGSQVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 11899 - protein, 367 aa, Artificial Sequence
  Synthetic Polypeptide
MNFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVLGGGGSGGGGSGGGGSQVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 11900 - protein, 502 aa, Artificial Sequence
  Synthetic Polypeptide
MALPVTALLLPLALLLHAARPNFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVLGGGGSGGGGSGGGGSQVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11901 - protein, 354 aa, Artificial Sequence
  Synthetic Polypeptide
MALPVTALLLPLALLLHAARPNFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVLGGGGSGGGGSGGGGSQVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 11902 - protein, 354 aa, Artificial Sequence
  Synthetic Polypeptide
MALPVTALLLPLALLLHAARPNFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVLGGGGSGGGGSGGGGSQVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 11903 - protein, 457 aa, Artificial Sequence
  Synthetic Polypeptide
MALPVTALLLPLALLLHAARPNFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVLGGGGSGGGGSGGGGSQVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 11904 - protein, 457 aa, Artificial Sequence
  Synthetic Polypeptide
MALPVTALLLPLALLLHAARPNFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVLGGGGSGGGGSGGGGSQVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 11905 - protein, 347 aa, Artificial Sequence
  Synthetic Polypeptide
MALPVTALLLPLALLLHAARPNFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVLGGGGSGGGGSGGGGSQVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSSTRIEVMYPPPYLDNEKSNGTIIHVKGKHLCPSPLFPGPSKPFWVLVVVGGVLACYSLLVTVAFIIFWVRSKRS

SEQ ID NO: 11906 - protein, 456 aa, Artificial Sequence
  Synthetic Polypeptide
MALPVTALLLPLALLLHAARPNFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVLGGGGSGGGGSGGGGSQVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 11907 - protein, 456 aa, Artificial Sequence
  Synthetic Polypeptide
MALPVTALLLPLALLLHAARPNFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVLGGGGSGGGGSGGGGSQVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 11908 - protein, 316 aa, Artificial Sequence
  Synthetic Polypeptide
MALPVTALLLPLALLLHAARPNFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVLGGGGSGGGGSGGGGSQVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSSTRAAGGAVHTRGLDFACDIYIWAPLAGTCGVLLLSLVITLYC

SEQ ID NO: 11909-11914 - skipped (6 entries)

SEQ ID NO: 11915 - DNA, 5446 bp, Artificial Sequence
  Synthetic Polynucleotide
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccactagtaacggccgccagtgtgctggaattctgcagatatccatcacactggcggccgctcgagcatgcatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 11916 - DNA, 3001 bp, Artificial Sequence
  Synthetic Polynucleotide
atgaagtgccttttgtacttagcctttttattcattggggtgaattgcaagttcaccatagtttttccacacaaccaaaaaggaaactggaaaaatgttccttctaattaccattattgcccgtcaagctcagatttaaattggcataatgacttaataggcacagccttacaagtcaaaatgcccaagagtcacaaggctattcaagcagacggttggatgtgtcatgcttccaaatgggtcactacttgtgatttccgctggtatggaccgaagtatataacacattccatccgatccttcactccatctgtagaacaatgcaaggaaagcattgaacaaacgaaacaaggaacttggctgaatccaggcttccctcctcaaagttgtggatatgcaactgtgacggatgccgaagcagtgattgtccaggtgactcctcaccatgtgctggttgatgaatacacaggagaatgggttgattcacagttcatcaacggaaaatgcagcaattacatatgccccactgtccataactctacaacctggcattctgactataaggtcaaagggctatgtgattctaacctcatttccatggacatcaccttcttctcagaggacggagagctatcatccctgggaaaggagggcacagggttcagaagtaactactttgcttatgaaactggaggcaaggcctgcaaaatgcaatactgcaagcattggggagtcagactcccatcaggtgtctggttcgagatggctgataaggatctctttgctgcagccagattccctgaatgcccagaagggtcaagtatctctgctccatctcagacctcagtggatgtaagtctaattcaggacgttgagaggatcttggattattccctctgccaagaaacctggagcaaaatcagagcgggtcttccaatctctccagtggatctcagctatcttgctcctaaaaacccaggaaccggtcctgctttcaccataatcaatggtaccctaaaatactttgagaccagatacatcagagtcgatattgctgctccaatcctctcaagaatggtcggaatgatcagtggaactaccacagaaagggaactgtgggatgactgggcaccatatgaagacgtggaaattggacccaatggagttctgaggaccagttcaggatataagtttcctttatacatgattggacatggtatgttggactccgatcttcatcttagctcaaaggctcaggtgttcgaacatcctcacattcaagacgctgcttcgcaacttcctgatgatgagagtttattttttggtgatactgggctatccaaaaatccaatcgagcttgtagaaggttggttcagtagttggaaaagctctattgcctcttttttctttatcatagggttaatcattggactattcttggttctccgagttggtatccatctttgcattaaattaaagcacaccaagaaaagacagatttatacagacatagagatgaaccgacttggaaagtaaggccgcggtaacaattgttaactaacttaagctagcaacggtttccctctagcgggatcaattccgccccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgataataccatgactagtaccatgaactccttctccacaagcgccttcggtccagttgccttctccctgggcctgctcctggtgttgcctgctgccttccctgccccagtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11917 - DNA, 1536 bp, Artificial Sequence
  Synthetic Polynucleotide
atgaagtgccttttgtacttagcctttttattcattggggtgaattgcaagttcaccatagtttttccacacaaccaaaaaggaaactggaaaaatgttccttctaattaccattattgcccgtcaagctcagatttaaattggcataatgacttaataggcacagccttacaagtcaaaatgcccaagagtcacaaggctattcaagcagacggttggatgtgtcatgcttccaaatgggtcactacttgtgatttccgctggtatggaccgaagtatataacacattccatccgatccttcactccatctgtagaacaatgcaaggaaagcattgaacaaacgaaacaaggaacttggctgaatccaggcttccctcctcaaagttgtggatatgcaactgtgacggatgccgaagcagtgattgtccaggtgactcctcaccatgtgctggttgatgaatacacaggagaatgggttgattcacagttcatcaacggaaaatgcagcaattacatatgccccactgtccataactctacaacctggcattctgactataaggtcaaagggctatgtgattctaacctcatttccatggacatcaccttcttctcagaggacggagagctatcatccctgggaaaggagggcacagggttcagaagtaactactttgcttatgaaactggaggcaaggcctgcaaaatgcaatactgcaagcattggggagtcagactcccatcaggtgtctggttcgagatggctgataaggatctctttgctgcagccagattccctgaatgcccagaagggtcaagtatctctgctccatctcagacctcagtggatgtaagtctaattcaggacgttgagaggatcttggattattccctctgccaagaaacctggagcaaaatcagagcgggtcttccaatctctccagtggatctcagctatcttgctcctaaaaacccaggaaccggtcctgctttcaccataatcaatggtaccctaaaatactttgagaccagatacatcagagtcgatattgctgctccaatcctctcaagaatggtcggaatgatcagtggaactaccacagaaagggaactgtgggatgactgggcaccatatgaagacgtggaaattggacccaatggagttctgaggaccagttcaggatataagtttcctttatacatgattggacatggtatgttggactccgatcttcatcttagctcaaaggctcaggtgttcgaacatcctcacattcaagacgctgcttcgcaacttcctgatgatgagagtttattttttggtgatactgggctatccaaaaatccaatcgagcttgtagaaggttggttcagtagttggaaaagctctattgcctcttttttctttatcatagggttaatcattggactattcttggttctccgagttggtatccatctttgcattaaattaaagcacaccaagaaaagacagatttatacagacatagagatgaaccgacttggaaagtaa

SEQ ID NO: 11918 - DNA, 3006 bp, Artificial Sequence
  Synthetic Polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatctccaccatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatctcgagaccgatttctacgactacaaggacgacgatgacaagactagtggctccggcgagggcagaggaagtctactaacctgcggagatgtggaagaaaatcctggcccaatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 11919 - DNA, 2286 bp, Artificial Sequence
  Synthetic Polynucleotide
atggccttaccagtgaccgccttgctcctgccgctggccttgctgctccacgccgccaggccgcaggttcagctgcaagagtctggccctggcctggtcaagcctagccaaacactgagcctgacctgtaccgtgtctggcggcagcatcaacaacaacaattactactggacctggatcagacagcaccccggcaaaggactggaatggatcggctacatctactacagcggcagcaccttctacaaccccagcctgaagtccagagtgaccatcagcgtggacaccagcaagacccagttctccctgaagctgagcagcgtgacagccgccgatacagccgtgtactactgcgccagagaagataccatgaccggcctggatgtgtggggccagggaacaacagtgacagtgtctagcggcggaggcggaagtggaggcggaggatctggcggcggaggctctgacattcagatgacacagagccctagcagcctgagcgcctctgtgggagacagagtgacaattacctgtcgggccagccagtctatcaacaactacctgaactggtatcagcagaagcccggcaaggcccctacactgctgatctatgccgccagctctctccagagcggagtgcctagcagattcagcggaagcagaagcggcaccgacttcaccctgacaatatccagcctccagcctgaggacttcgccgcctacttttgccagcagacctacagcaaccccacctttggccagggcaccaaggtggaagtgaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccaatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 11920 - skipped

SEQ ID NO: 11921 - DNA, 507 bp, Artificial Sequence
  Synthetic Polynucleotide
atgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgac

SEQ ID NO: 11922 - DNA, 513 bp, Artificial Sequence
  Synthetic Polynucleotide
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 11923 - DNA, 444 bp, Artificial Sequence
  Synthetic Polynucleotide
atggaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgac

SEQ ID NO: 11924 - DNA, 459 bp, Artificial Sequence
  Synthetic Polynucleotide
atgaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacaga

SEQ ID NO: 11925 - DNA, 618 bp, Artificial Sequence
  Synthetic Polynucleotide
atgctgcctgccagccccaccgacagatccatcgtgctggacaacggctacgtgtgcagctgggagggcatccccgacgacctgagagactgccccaagaccgaggacatgagcaagcagcatggcgctgccctgaagctgccccccgatgtgctggacgagatggaatgcaacgccaagaaaagcggctgcgtgcggggctgcctccagtgtctggccctgattaagtgcaccgccaagatgcggaagtacatccccggcagatgccacagctacgagggcgacaaggacattgcccagggcggcatcggcaaagagctgaccatcgacatccccgagatccccggcttcctggacctggcccctatggatcagttcgtggcccaggtggacctgtgcgtggactgctccagcagatgcctgaagggcctggctaacgtgcagtgctcctgcaagctgtataagtggctgcccaccagatgcaccggcttccaggccaagatcaagaaagaggccgacaccgtgatcggactggaagatgccctggccctgggcttcgacaccatccaggcttgtgtggccgctggcaagtgcaaggacaccgtgggcagatacagc

SEQ ID NO: 11926 - DNA, 507 bp, Artificial Sequence
  Synthetic Polynucleotide
atggccgcctctgaagaggccgatgacgatcacgtgtccctcgtgaagaactactggcggatcggcgtgggcaacgagcgggatgtgtctctggatagaggcggccctcccaagctgagcaaagaactgctggccgagatgcacgccattgccagcaatgccggctgctccagagtgtgcctgatcggcctgagcaagatcaagtgcacccccaagatgaagaccttcctgcccggcagatgcaacaccttcgcccctaaacctgccaccggcgacggaccttttgccgccgctgctgccatccctggcttcagcgatctgaccgctatggaacagtacaaggcccaggtggcccagtgcgactgctccaacagatgcctcgtgggcctggctaacatcaagtgttctgccgccctgaaggccgccctgcctcagagatgtaccacctttgccaccaacatccagaaagagggcgaggtggacagcatcaagggctacggcagaaag

SEQ ID NO: 11927 - DNA, 585 bp, Artificial Sequence
  Synthetic Polynucleotide
atgcagcccaccgagaacaagcaggaaagccagatcgaggacatcgacagaagcaccagcctgggcctgatgtgctacgagcagtgtacaggccagagcggcctggatctgaagtgctacaaagagtgcgccgacttcaccggcgaccggaacagaggcagaaagctgcccggcaagaaactgcccctggaagtgctgaagatcatggaagccaacgccagaagggccggctgcaccagaggctgcctgatctgcctgagcaagatcaagtgcaccgccaagatgaagcagtacatccccggcagatgccacacctacgagggcgacaagtctatcggccagggcggcatcggaggccccatcgtggatatccctgagatcatcggcttccagaacatggaacctatggaacagtttatcgcccaggtggacctgtgcgccgattgcacaaccggctgtctgaagggcctggctaacgtgcggtgcaacgacctgctgaagaagtggctgcccgacagatgcgccggcttcgccaacaagatccagagcgaggtggacaacatcaagggactggccggcgacaga

SEQ ID NO: 11928 - DNA, 510 bp, Artificial Sequence
  Synthetic Polynucleotide
atgaagagcatagacagctacgaaaatattgatatagtggctgttgcgggcaacttcgctgctgttgaccaggacgctaaccgcggaggaaacctgccgggtaagaaaatgccaatagaggttcttaaagaaatggaagctaacgccaagcgagcagggtgtgttcggggctgtttgatatgcttgtcccacatcaaatgcacagctaaaatgaaaaaattcataccaggtcggtgtcatagctatcatggagatgcagatacgaagcaaggggcacttgaagaagtggttgacatgcccgagataccgggatttgtggacatggagcccatggaacagtttatagcccaggtggataaatgcgaggactgtaccactggttgtttgaaaggtctcgccaacgtccactgcagcgatctcctcaagaaatggctgccgcaaagatgctcacagtttgcggataagatccaatccgaggtggacacaataaagggcctggcaggggaccgg

SEQ ID NO: 11929 - DNA, 579 bp, Artificial Sequence
  Synthetic Polynucleotide
atgaacccgacggagaacaaggacgatattgatattgtgggagtggaaggcaaattcgggactacggatcttgaaactgatctctttacgattgttgaggacatgaacgtaatctcaagggatacgaacctggcaaatagtgacgcagaccgaggcaaaatgccgggaaaaaaacttccgttggaagtactgatcgagatggaagcgaatgcacgcaaggcagggtgtacacggggatgcttgatctgtctgagtaagattaaatgcaccgctaaaatgaaagtttatatacccggtcggtgccacgattatgggggcgataagaaaaccggtcaggcagggatcgtcggagcaatcgtggatattcctgaaatttcaggattcaaagaacttggaccaatggagcaatttatagcacaagtggacctctgcgctgactgcacgacgggatgtctgaaaggtcttgcaaatgtaaagtgttcagcactccttaagaaatggcttcccgaccgatgtgcctcttttgctgacaagattcagtctgaagttgataacataaagggtcttgcgggtgatcgg

SEQ ID NO: 11930 - DNA, 510 bp, Artificial Sequence
  Synthetic Polynucleotide
atgaagcctaccgaaaataatgatgatattgatatagttgggatcgcaagtacatttatcacgacaaacaccgacgcggaccggggcaagatgccgggaaagaaacttcccttggcagtcctcaaggaaatggaggcgaacgctgcaaaggcagggtgttccagaggttgtctgatctgcttgtctaaaatcaagtgtacagctaagatgaagcagtttattccggggcgctgtcacgactacggtggtgataaaaaaacgggccaggcggcgctggtcggagcaatattcgacatccctgaaatcttcggatttctcgatatggaacctatcgagcagttcatagcacaagtagatttgtgtgctggctgcacaacaggctgcttgaaaggactcgcaaatattaagtgttctgaactcttgaagaagtggcttccgaaaagatgtacctccttcgcgtataaaatgcaaaaggaaatgcacaatataaaaggcatggcaggagatcgg

SEQ ID NO: 11931 - DNA, 510 bp, Artificial Sequence
  Synthetic Polynucleotide
atgaaagcgaccgaaaacaatgacgacatagacatagttggaatcgcgtcaaccttcataacgacaaacacggacgccgaccgaggcaaaatgccggggaaaagattgccactggcggtgttgaaagagatggaagcgaacgcagtcaaagcgggatgtagcaggggctgccttatatgtctgagtaagattaaatgcaccgcgaagatgaagcaatacatccccggcaggtgccacgattacggaggagacaagaagaccgggcaggcggctatagagggcgcgatagatgatattcctgaaatctctggctttaaggagatggcgcctatggagcaattcattgcgcaggttgacttgtgcgcagactgcacgacaggatgcctcaagggcttggcaaatgtaaaatgttccgaacttctgaaaaaatggctgcccaagaggtgtacctccttcgccacgaagatgcaaaaggagatccataacatcaaaggcatggggggggaccgc

SEQ ID NO: 11932 - DNA, 588 bp, Artificial Sequence
  Synthetic Polynucleotide
atgaaccctacggagacccaggacggagtggacattctcggcgtggaagggaaattcgggacagaaaccaacttggagactgatctgtttaccatttgggagataaatggaataattaaatctgatcgcgacacaaatagggcaaatgcagacgctgatcgaggaaaaatgcccggcaagaaacttcctttggcggtgctcatagagatggaggcaaacgcattcaaagcgggttgcactcgcggttgtctcatttgtttgtccaaaatcaaatgcacggctaagatgaaagagtatatcccaggacggtgccatgattacggtggggataaaaaaacgggacaagcaggtatagtaggtgctatcgtggacattccagaaatctcaggatttaaagagcttggccccatggagcaattcatagcgcaagtagacctttgcgctgattgcactactggctgtcttaagggactggcgaatgttaagtgcagcgccctgttgaagaagtggctgccagaccgatgcgcatcattcgcggataagatacagtccgaagtccataatataaaaggtctcgcaggtgatcgc

SEQ ID NO: 11933 - DNA, 522 bp, Artificial Sequence
  Synthetic Polynucleotide
atggccacaatcaatgaaaatttcgaagacatcgaccttgtcgcgattggaggctcatttgctacagatgtggacgccaacaggggtggtcatggtggacatccgggcaaaaagatgcctaaagaggtcttgttggaaatggaagcgaacgcaaaacgagccggatgtcataggggttgtttgatttgtctttctcacatcaaatgtacgcagaagatgaagaaattcataccgggacggtgtcactcctatgctggtgacaaggatagcgctcagggcggcataacagaggaggagactgttgacatgcccgagatcgctgggttcaaggatcttgaacctatggagcagtttattgcacaggtagacttgtgcgttgactgcacaactggttgtttgaaagggctggccaacgtccactgttctgacttgctcaaaaagtggctgccttcccggtgcaagacttttgcctcaaaaattcagagtcaggttgacaccatcaaggggttggctggtgacagg

SEQ ID NO: 11934 - DNA, 579 bp, Artificial Sequence
  Synthetic Polynucleotide
atgaatcctacagagaacaatgatcatatcaatattgtcgggatcgagggtaaattcggaatcacagacttggagacggatctcttcactatctgggagacaaatcgcatgatttctaccgataacgaacaggcaaatacagacagtaatagagggaagatgccaggtaagaaactgccattggcagttcttatagagatggaagccaacgctttcaaggcgggttgtacaagaggctgtctcatttgcttgtctaaaatcaagtgtactgctaagatgaagaaatacataccgggaagatgccatgactacggaggtgataagaagactgggcaggcaggaatcgtgggcgcgattgtcgacatacccgacatatccgggttcaaggaaatgggaccgatggagcaattcatcgcccaagtggatcgatgcaccgactgcacaacgggatgtttgaagggtcttgcaaatgttaagtgctccgagctgttgaagaagtggttgccggaccgctgcgcgagtttcgccgataaaattcaaagtgaggtgcataatattaaaggtctggcgggagatcgc

SEQ ID NO: 11935 - DNA, 498 bp, Artificial Sequence
  Synthetic Polynucleotide
atgcaacccactgagaataaaaaggaatcctataccgaagacacagacgtaaacggggaccatgatcgaggcaggaagcttccggggaagaaacttccactggaagttctgaaaatcatggaagctaacgcaaggagagcaggttgcacgcgaggctgtttgatatgtcttagcaagataaaatgtactgcaaaaatgaagcaatacataccgggaagatgccatacttatgagggggacaaaagcatagggcaggcaggcataggaggcccaatcattgatataccggaaattatagggtttaagaacatggaaccaatggaacagttcatcgcacaggtggatctctgtgcggactgcactactggatgcctcaaaggtctcgcaaatgtaagatgcaacgatcttttgaaaaaatggttgccagatcgatgcgcggggttcgcactcaagatacaaggtgaagtggaaaacataaaggggatggccggggatcga

SEQ ID NO: 11936 - DNA, 618 bp, Artificial Sequence
  Synthetic Polynucleotide
atgcttccagcgtcacccaccgataggtcaatagtccttgacaacggctatgtgtgttcctgggagggtatcccagacgacctgcgggactgtccgaagacagaggatatgtctaagcagcacggagctgctctcaaactgccgccagatgtgttggatgagatggaatgtaatgctaaaaagagtggatgcgtgcgaggatgtcttcagtgtctggcactcataaaatgtactgcaaaaatgagaaagtatatccccggacgctgtcatagctacgagggtgacaaggacattgctcagggggggatcggaaaggaactgacaattgacatccctgagattcctggcttcttggatcttgcaccaatggaccagttcgtggcgcaggtcgacctctgcgtggactgcagcagtcggtgcctgaagggcttggctaatgtccaatgcagttgtaagctctacaaatggttgccaacccggtgtaccggcttccaagcgaaaataaagaaagaagctgacacggtaattgggctggaagatgcgctcgcactcggattcgacaccatccaggcatgcgtagcggccggtaaatgcaaggatacggttggccggtactct

SEQ ID NO: 11937 - DNA, 534 bp, Artificial Sequence
  Synthetic Polynucleotide
atgtgggcggcctccgaggaggccgatgacgacctcgtatctttggtcaaaaactactggggcgtaggcgtaagcaatgaacgcgatgtatctctcgacagggggggccatggcaagctgccgaaaaagcttagcgttgagattctcgctgaaatggaagcaaacgcccagaagagtaattgctctcgggggtgtctgatagggctttctaaaattaaatgcacgcccaaaatgaaaaaattcctccctggcaggtgccacgaatactctggtgatcccaaaactggacagggtccgcttactgcggctgcggttataccagggtatagtgatcttacagctatggagcagttcaagctccaagtagacaagtgtgactgttcaactcaatgtcttaagggtcttgcaaatgtcaagtgctcagcggccctcaaagcggtgttgccaacaagatgctcacaattcgcaactcagatccaagctgaagtaggcaccataaaagggaaggggaagaaaccgactccaccgataggt

SEQ ID NO: 11938 - DNA, 579 bp, Artificial Sequence
  Synthetic Polynucleotide
atgaaacccactgaaatcaatgaagacctcaatatagctgctgtggcctccaactttgccaccacagatcttgagactgacctgttcaccaactgggagaccatgaatgtgattagcactgacacagagcaggtgaacacagatgctgacaggggcaagctgcctggcaaaaaactccccccagatgtcctgagggagctggaggccaatgccagaagggctggttgcacaagaggctgcctcatttgcctctcccacattaagtgcacccctaagatgaagaaatttatccctggcaggtgccacacttatgaaggtgaaaaggagtctgctcagggagggattggagaggcaattgttgatatcccagagattcctggcttcaaggataaggagccactggaccagtttattgctcaagtggacctctgtgctgattgcaccactggctgtctgaagggccttgccaatgtccagtgctctgacctcctgaagaagtggcttccccagaggtgtaccacttttgccagcaagattcagggtagggtggacaaaatcaagggtctggctggggacaga

SEQ ID NO: 11939 - DNA, 933 bp, Artificial Sequence
  Synthetic Polynucleotide
atggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcag

SEQ ID NO: 11940 - DNA, 1650 bp, Artificial Sequence
  Synthetic Polynucleotide
atggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtg

SEQ ID NO: 11941 - DNA, 1632 bp, Artificial Sequence
  Synthetic Polynucleotide
atggccgacaagaacatcctgtacggccccgagcctttctaccctctggaagatggaacagccggcgagcagatgttcgacgccctgagcagatatgccgccattcctggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacagcctccagttcttcctgcctgtgatcgccagcctgtacctgggcattattgtggcccctgtgaacgacaagtacatcgagagagagctgatccacagcctgggcatcgtgaagccccggatcgtgttctgctccaagaacaccttccagaaggtgctgaacgtcaagagcaagctgaagtccatcgagacaatcatcatcctggacctgaacgaggacctcggcggctaccagtgcctgaacaacttcatcagccagaacagcgacagcaacctggacgtgaagaagttcaagccctacagcttcaaccgggacgaccaggtggcctccatcatgtttagcagcggcaccaccggactgcccaaaggcgttatgctgacccacaagaatatcgtggcccggttctctatcgctaaggaccccaccttcggcaacgccatcaatcctacaagcgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggccttcctggctaagtctgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaagggcgacgccaagcctggcagcacaggcaaaattgtgcctctgcacgccgtgaaggtggtggaccctaccacaggcaagatcctgggacctaatgagcccggcgagctgtacttcaagggacccatgattatgaagggctactacaacaacgaggaagccaccaaggccattatcgacaacgacggctggctgcggagcggcgatattgcctactacgacaatgacggccacttctacatcgtggacagactgaagtccctcatcaagtacaagggctatcaggtggccccagccgagatcgagggtatcctgctgcaacacccctatatcgtggatgccggcgtgacaggcatccctgatgaagctgctggcgaacttccagcagctggcgtggtggttcagaccggcaagtacctgaatgagcagatcgtgcaggactacgtggcctctcaggtgtccacagccaaatggctgagaggcggcgtgaagttcctggacgagatcccaaagggctctaccggcaagatcgacagaaaggtgctgcggcagatgctggaaaagcacaccaatggc

SEQ ID NO: 11942 - DNA, 1632 bp, Artificial Sequence
  Synthetic Polynucleotide
atggccgacaagaacatcctgtacggccccgagcctttctaccctctggaagatggaacagccggcgagcagatgttcgacgccctgagcagatacgccgacattcctggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacagcctccagttcttcctgcctgtgatcgccagcctgtacctgggcattattgtggcccctgtgaacgacaagtacatcgagagagagctgatccacagcctgggcatcgtgaagccccggatcgtgttctgctccaagaacaccttccagaaggtgctgaacgtcaagagcaagctgaagtccatcgagacaatcatcatcctggacctgaacgacgacctcggcggctaccagtgcctgaacaacttcatcagccagaacagcgacagcaacctggacgtgaagaagttcaagccctacagcttcaaccgggacgaccaggtggccctgattatgtttagcagcggcaccaccggactgcccaaaggcgttatgctgacccacaagaatatcgtggcccggttctctatcgctaaggaccccaccttcggcaacgccatcaatcctacaagcgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggccttcctggctaagtctgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaagggcgacgccaagcctggcagcacaggcaagattgtgcctttccacgccgtgaaggtggtggaccctaccaccggaaagatcctgggacctaatgagcccggcgagctgtacttcaagggacccatgattatgaagggctactacaacaacgaggaagccaccaaggccattatcgacaacgacggctggctgcggagcggcgatattgcctactacgacaatgacggccacttctacatcgtggacagactgaagtccctcatcaagtacaagggctaccaggtcgcccctgccgagattgagggtatcctgctgcaacacccctatatcgtggatgccggcgtgacaggcatccctgatgaagctgctggcgaacttccagcagctggcgtggtggttcagaccggcaagtacctgaatgagcagatcgtgcaggactacgtggcctctcaggtgtccacagccaaatggctgagaggcggcgtgatcttcctggacgagatcccaaagggctctaccggcaagatcgacagaaaggtgctgcggcagatgctggaaaagcacaccaatggc

SEQ ID NO: 11943 - DNA, 1632 bp, Artificial Sequence
  Synthetic Polynucleotide
atggccgacaagaacatcctgtacggccccgagcctttctaccctctggctgatggaacagccggcgagcagatgttcgatgccctgagcagatacgccgacatcagcggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacggcctccagttctttctgcctgtgatcgccagcctgtacctgggcattatcgctgcccctgtgtccgataagtacatcgagagagagctgatccacagcctgggcatcgtgaagccccggatcatcttctgctccaagaacaccttccagaaggtgctgaacgtcaagagcaagctgaagtccgtggaaaccatcatcatcctggacctgaacgaggacctcggcggctaccagtgcctgaacaacttcatctctcagaacagcgacagcaacctggacgtgaagaagttcaagccctacagcttcaaccgggacgaccaggtggccctggtcatgtttagctctggcacaaccggcgtgcccaagggcgttatgctgacccacaagaatatcgtggcccggttcagcctggctaaggaccctaccttcggcaacgccatcaatcccaccaccgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggcctttctggccaagtctgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaagggcgacgctagacctggcagcacaggcaagatcgtgcctttccacgccgtgaaggtggtggaccctacaaccggcaagatcctgggacctaatgagcccggcgagctgtactttaagggcgccatgattatgaagggctactacaacaacgaggaagccaccaaggccattatcgacaacgacggctggctgcggagcggcgatattgcctactacgacaatgacggccacttctacatcgtggacagactgaagtccctcatcaagtacaagggctaccaggtcgcccctgccgagattgagggtatcctgctgcaacacccctatatcgtggatgccggcgtgacaggcatccctgatgaagctgctggcgaacttccagcagcaggcgtggtggttcagaccggcaagtacctgaatgagcagatcgtgcaggacttcgtgtccagccaggtgtccacagccaaatggctgagaggcggcgtgaagttcctggacgagatcccaaagggctccaccggaaagatcgacagaaaggtgctgcggcagatgtttgagaagcacaccaacggc

SEQ ID NO: 11944 - DNA, 1632 bp, Artificial Sequence
  Synthetic Polynucleotide
atggccgacaagaacatcctgtacggccccgagcctttctaccctctggctgatggaacagccggcgagcagatgttctacgccctgagcagatacgccgacatcagcggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacggcctccagttcttcctgcctatcattgccagcctgtacctgggcatcattgctgcccctgtgtccgataagtacatcgagagagagctgatccactctctgggcatcgtgaagccccggatcatcttctgctccaagaacaccttccagaaggtgctgaacgtcaagagcaagctgaaatacgtggaaaccatcatcatcctggacctgaacgaggacctcggcggctaccagtgcctgaacaacttcatctctcagaacagcgacatcaacctggacgtcaagaagttcaagccctacagcttcaaccgggacgaccaggtggccctggtcatgtttagctctggcacaaccggcgtgtccaagggcgtgatgctgacccacaagaatatcgtggcccggttcagcctggctaaggaccctaccttcggcaacgccatcaatcccaccaccgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggcctttctggctaagagcgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaacaacgatgtgcggcctggcagcacaggcaagatcgtgccttttcacgccgtgaaggtggtggaccctacaaccggcaagatcctgggacctaatgagcccggcgagctgtacttcaagggcgacatgattatgaagggctactacaacaacgaggaagccaccaaggccattatcaacaaggacggctggctgcggagcggcgacattgcctactatgacaacgacggccacttctacatcgtggaccggctgaagtccctgattaagtacaagggctaccaggtcgcccctgccgagattgagggtatcctgctgcaacacccctatatcgtggatgccggcgtgacaggcatccctgatgaagctgctggcgaacttccagcagctggcgtggtggttcagaccggcaagtacctgaatgagcagatcgtgcagaatttcgtgtccagccaggtgtccaccgccaagtggcttagaggcggcgtgaagttcctggacgagatccctaaaggctccaccggaaagatcgacagaaaggtgctgcgccagatgttcgagaagcacaccaatggc

SEQ ID NO: 11945 - DNA, 1626 bp, Artificial Sequence
  Synthetic Polynucleotide
atgatgaagcgcgagaagaacgtgatctacggccccgaacctctgcaccctcttgaggatcttacagccggcgagatgctgttcagagccctgcggaaacacagccatctgcctcaggctctggtggatgtcgtgggagatgagagcctgtcctacaaagagttcttcgaggccaccgtgctgctggcccagtctctgcataattgcggctacaagatgaacgacgtggtgtccatctgcgccgagaacaacacccggttcttcatccctgtgatcgccgcctggtacatcggcatgattgtggcccctgtgaacgagagctacatccccgacgagctgtgcaaagtgatgggcatcagcaagccccagatcgtgttcaccaccaagaacatcctgaacaaggtgctggaagtgcagagccggaccaacttcatcaagcggatcatcatcctggacaccgtggaaaacatccacggctgcgagagcctgccaaacggcatctccagatacagcgacggcaatatcgccaacttcaagcccctgcacttcgaccccgtggaacaggtggcagccatcctgtgtagcagcggcacaacaggactgcccaaaggcgtgatgcagacccaccagaatatctgcgtgcggctgatccacgctctggaccctagagctggaacccagctgattcctggcgtgaccgtgctggtgtacctgcctttctttcacgccttcggcttcagcatcaccctgggctacttcatggtcggactgagagtgattatgtttcggcgcttcgaccaagaagccttcctgaaggccatccaggactacgaagtgcgctccgtgattaacgtgcccagcgtgatcctgttcctgagcaagagcccactggtggataagtacgacctgagcagcctgagagagctgtgttgcggagctgcccctctggctaaagaggtggcagaagttgccgccaagcggctgaatctgcctggcatcagatgtggctttggcctgaccgagagcaccagcgccaatatccacagcctgcgggacgagtttaagagcggctctctgggcagagtgacccctctgatggccgccaagatcgccgatagagagacaggcaaagccctgggacctaatcaagtgggcgagctgtgtatcaagggacctatggtgtccaagggctacgtgaacaacgtggaagccaccaaagaggccatcgacgacgacggctggctgcactctggcgatttcggctactacgacgaggacgagcacttctacgtggtggacagatacaaagagctgattaagtacaagggcagccaggtggccccagccgagctggaagaaatcctgctgaagaacccctgcatccgcgacgtggcagttgtgggcattcctgatctggaagccggcgaactgcctagcgcctttgtggttaagcagcccggcaaagagatcaccgccaaagaggtgtacgactacctggccgagagagtgtcccacaccaagtatctgagaggcggcgtcagattcgtggacagcatccccagaaacgtgaccggcaagatcacccggaaagagctgctgaaacagctgctggaaaaggctggcgga

SEQ ID NO: 11946 - DNA, 1626 bp, Artificial Sequence
  Synthetic Polynucleotide
atggtaaagcgtgagaaaaatgtcatctatggccctgagcctctccatcctttggaggatttgactgccggcgaaatgctgtttcgtgctctccgcaagcactctcatttgcctcaagccttggtcgatgtggtcggcgatgaatctttgagctacaaggagttttttgaggcaaccgtcttgctggctcagtccctccacaattgtggctacaagatgaacgacgtcgttagtatctgtgctgaaaacaatacccgtttcttcattccagtcatcgccgcatggtatatcggtatgatcgtggctccagtcaacgagagctacattcccgacgaactgtgtaaagtcatgggtatctctaagccacagattgtcttcaccactaagaatattctgaacaaagtcctggaagtccaaagccgcaccaactttattaagcgtatcatcatcttggacactgtggagaatattcacggttgcgaatctttgcctaatttcatctctcgctattcagacggcaacatcgcaaactttaaaccactccacttcgaccctgtggaacaagttgcagccattctgtgtagcagcggtactactggactcccaaagggagtcatgcagacccatcaaaacatttgcgtgcgtctgatccatgctctcgatccacgctacggcactcagctgattcctggtgtcaccgtcttggtctacttgcctttcttccatgctttcggctttcatattactttgggttactttatggtcggtctccgcgtgattatgttccgccgttttgatcaggaggctttcttgaaagccatccaagattatgaagtccgcagtgtcatcaacgtgcctagcgtgatcctgtttttgtctaagagcccactcgtggacaagtacgacttgtcttcactgcgtgaattgtgttgcggtgccgctccactggctaaggaggtcgctgaagtggccgccaaacgcttgaatcttccagggattcgttgtggcttcggcctcaccgaatctaccagtgcgattatccagactctcggggatgagtttaagagcggctctttgggccgtgtcactccactcatggctgctaagatcgctgatcgcgaaactggtaaggctttgggcccgaaccaagtgggcgagctgtgtatcaaaggccctatggtgagcaagggttatgtcaataacgttgaagctaccaaggaggccatcgacgacgacggctggttgcattctggtgattttggatattacgacgaagatgagcatttttacgtcgtggatcgttacaaggagctgatcaaatacaagggtagccaggttgctccagctgagttggaggagattctgttgaaaaatccatgcattcgcgatgtcgctgtggtcggcattcctgatctggaggccggcgaactgccttctgctttcgttgtcaagcagcctggtacagaaattaccgccaaagaagtgtatgattacctggctgaacgtgtgagccatactaagtacttgcgtggcggcgtgcgttttgttgactccatccctcgtaacgtaacaggcaaaattacccgcaaggagctgttgaaacaattgttggtgaaggccggcggt

SEQ ID NO: 11947 - DNA, 1470 bp, Artificial Sequence
  Synthetic Polynucleotide
atgatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtatgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccgggt

SEQ ID NO: 11948 - DNA, 708 bp, Artificial Sequence
  Synthetic Polynucleotide
atggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaag

SEQ ID NO: 11949 - DNA, 717 bp, Artificial Sequence
  Synthetic Polynucleotide
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaag

SEQ ID NO: 11950 - skipped

SEQ ID NO: 11951 - DNA, 822 bp, Artificial Sequence
  Synthetic Polynucleotide
atgaactccttctccacaagcgccttcggtccagttgccttctccctgggcctgctcctggtgttgcctgctgccttccctgccccagtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11952 - DNA, 795 bp, Artificial Sequence
  Synthetic Polynucleotide
atggccttaccagtgaccgccttgctcctgccgctggccttgctgctccacgccgccaggccgatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11953 - DNA, 801 bp, Artificial Sequence
  Synthetic Polynucleotide
atggccttaccagtgaccgccttgctcctgccgctggccttgctgctccacgccgccaggccgatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11954 - DNA, 732 bp, Artificial Sequence
  Synthetic Polynucleotide
atggccttaccagtgaccgccttgctcctgccgctggccttgctgctccacgccgccaggccgatggaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11955 - DNA, 747 bp, Artificial Sequence
  Synthetic Polynucleotide
atggccttaccagtgaccgccttgctcctgccgctggccttgctgctccacgccgccaggccgatgaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11956 - DNA, 906 bp, Artificial Sequence
  Synthetic Polynucleotide
atggccttaccagtgaccgccttgctcctgccgctggccttgctgctccacgccgccaggccgatgctgcctgccagccccaccgacagatccatcgtgctggacaacggctacgtgtgcagctgggagggcatccccgacgacctgagagactgccccaagaccgaggacatgagcaagcagcatggcgctgccctgaagctgccccccgatgtgctggacgagatggaatgcaacgccaagaaaagcggctgcgtgcggggctgcctccagtgtctggccctgattaagtgcaccgccaagatgcggaagtacatccccggcagatgccacagctacgagggcgacaaggacattgcccagggcggcatcggcaaagagctgaccatcgacatccccgagatccccggcttcctggacctggcccctatggatcagttcgtggcccaggtggacctgtgcgtggactgctccagcagatgcctgaagggcctggctaacgtgcagtgctcctgcaagctgtataagtggctgcccaccagatgcaccggcttccaggccaagatcaagaaagaggccgacaccgtgatcggactggaagatgccctggccctgggcttcgacaccatccaggcttgtgtggccgctggcaagtgcaaggacaccgtgggcagatacagcctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11957 - DNA, 795 bp, Artificial Sequence
  Synthetic Polynucleotide
atggccttaccagtgaccgccttgctcctgccgctggccttgctgctccacgccgccaggccgatggccgcctctgaagaggccgatgacgatcacgtgtccctcgtgaagaactactggcggatcggcgtgggcaacgagcgggatgtgtctctggatagaggcggccctcccaagctgagcaaagaactgctggccgagatgcacgccattgccagcaatgccggctgctccagagtgtgcctgatcggcctgagcaagatcaagtgcacccccaagatgaagaccttcctgcccggcagatgcaacaccttcgcccctaaacctgccaccggcgacggaccttttgccgccgctgctgccatccctggcttcagcgatctgaccgctatggaacagtacaaggcccaggtggcccagtgcgactgctccaacagatgcctcgtgggcctggctaacatcaagtgttctgccgccctgaaggccgccctgcctcagagatgtaccacctttgccaccaacatccagaaagagggcgaggtggacagcatcaagggctacggcagaaagctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11958 - DNA, 873 bp, Artificial Sequence
  Synthetic Polynucleotide
atggccttaccagtgaccgccttgctcctgccgctggccttgctgctccacgccgccaggccgatgcagcccaccgagaacaagcaggaaagccagatcgaggacatcgacagaagcaccagcctgggcctgatgtgctacgagcagtgtacaggccagagcggcctggatctgaagtgctacaaagagtgcgccgacttcaccggcgaccggaacagaggcagaaagctgcccggcaagaaactgcccctggaagtgctgaagatcatggaagccaacgccagaagggccggctgcaccagaggctgcctgatctgcctgagcaagatcaagtgcaccgccaagatgaagcagtacatccccggcagatgccacacctacgagggcgacaagtctatcggccagggcggcatcggaggccccatcgtggatatccctgagatcatcggcttccagaacatggaacctatggaacagtttatcgcccaggtggacctgtgcgccgattgcacaaccggctgtctgaagggcctggctaacgtgcggtgcaacgacctgctgaagaagtggctgcccgacagatgcgccggcttcgccaacaagatccagagcgaggtggacaacatcaagggactggccggcgacagactcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11959 - DNA, 798 bp, Artificial Sequence
  Synthetic Polynucleotide
atggccttaccagtgaccgccttgctcctgccgctggccttgctgctccacgccgccaggccgatgaagagcatagacagctacgaaaatattgatatagtggctgttgcgggcaacttcgctgctgttgaccaggacgctaaccgcggaggaaacctgccgggtaagaaaatgccaatagaggttcttaaagaaatggaagctaacgccaagcgagcagggtgtgttcggggctgtttgatatgcttgtcccacatcaaatgcacagctaaaatgaaaaaattcataccaggtcggtgtcatagctatcatggagatgcagatacgaagcaaggggcacttgaagaagtggttgacatgcccgagataccgggatttgtggacatggagcccatggaacagtttatagcccaggtggataaatgcgaggactgtaccactggttgtttgaaaggtctcgccaacgtccactgcagcgatctcctcaagaaatggctgccgcaaagatgctcacagtttgcggataagatccaatccgaggtggacacaataaagggcctggcaggggaccggctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11960 - DNA, 867 bp, Artificial Sequence
  Synthetic Polynucleotide
atggccttaccagtgaccgccttgctcctgccgctggccttgctgctccacgccgccaggccgatgaacccgacggagaacaaggacgatattgatattgtgggagtggaaggcaaattcgggactacggatcttgaaactgatctctttacgattgttgaggacatgaacgtaatctcaagggatacgaacctggcaaatagtgacgcagaccgaggcaaaatgccgggaaaaaaacttccgttggaagtactgatcgagatggaagcgaatgcacgcaaggcagggtgtacacggggatgcttgatctgtctgagtaagattaaatgcaccgctaaaatgaaagtttatatacccggtcggtgccacgattatgggggcgataagaaaaccggtcaggcagggatcgtcggagcaatcgtggatattcctgaaatttcaggattcaaagaacttggaccaatggagcaatttatagcacaagtggacctctgcgctgactgcacgacgggatgtctgaaaggtcttgcaaatgtaaagtgttcagcactccttaagaaatggcttcccgaccgatgtgcctcttttgctgacaagattcagtctgaagttgataacataaagggtcttgcgggtgatcggctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11961 - DNA, 798 bp, Artificial Sequence
  Synthetic Polynucleotide
atggccttaccagtgaccgccttgctcctgccgctggccttgctgctccacgccgccaggccgatgaagcctaccgaaaataatgatgatattgatatagttgggatcgcaagtacatttatcacgacaaacaccgacgcggaccggggcaagatgccgggaaagaaacttcccttggcagtcctcaaggaaatggaggcgaacgctgcaaaggcagggtgttccagaggttgtctgatctgcttgtctaaaatcaagtgtacagctaagatgaagcagtttattccggggcgctgtcacgactacggtggtgataaaaaaacgggccaggcggcgctggtcggagcaatattcgacatccctgaaatcttcggatttctcgatatggaacctatcgagcagttcatagcacaagtagatttgtgtgctggctgcacaacaggctgcttgaaaggactcgcaaatattaagtgttctgaactcttgaagaagtggcttccgaaaagatgtacctccttcgcgtataaaatgcaaaaggaaatgcacaatataaaaggcatggcaggagatcggctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11962 - DNA, 798 bp, Artificial Sequence
  Synthetic Polynucleotide
atggccttaccagtgaccgccttgctcctgccgctggccttgctgctccacgccgccaggccgatgaaagcgaccgaaaacaatgacgacatagacatagttggaatcgcgtcaaccttcataacgacaaacacggacgccgaccgaggcaaaatgccggggaaaagattgccactggcggtgttgaaagagatggaagcgaacgcagtcaaagcgggatgtagcaggggctgccttatatgtctgagtaagattaaatgcaccgcgaagatgaagcaatacatccccggcaggtgccacgattacggaggagacaagaagaccgggcaggcggctatagagggcgcgatagatgatattcctgaaatctctggctttaaggagatggcgcctatggagcaattcattgcgcaggttgacttgtgcgcagactgcacgacaggatgcctcaagggcttggcaaatgtaaaatgttccgaacttctgaaaaaatggctgcccaagaggtgtacctccttcgccacgaagatgcaaaaggagatccataacatcaaaggcatggggggggaccgcctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11963 - DNA, 876 bp, Artificial Sequence
  Synthetic Polynucleotide
atggccttaccagtgaccgccttgctcctgccgctggccttgctgctccacgccgccaggccgatgaaccctacggagacccaggacggagtggacattctcggcgtggaagggaaattcgggacagaaaccaacttggagactgatctgtttaccatttgggagataaatggaataattaaatctgatcgcgacacaaatagggcaaatgcagacgctgatcgaggaaaaatgcccggcaagaaacttcctttggcggtgctcatagagatggaggcaaacgcattcaaagcgggttgcactcgcggttgtctcatttgtttgtccaaaatcaaatgcacggctaagatgaaagagtatatcccaggacggtgccatgattacggtggggataaaaaaacgggacaagcaggtatagtaggtgctatcgtggacattccagaaatctcaggatttaaagagcttggccccatggagcaattcatagcgcaagtagacctttgcgctgattgcactactggctgtcttaagggactggcgaatgttaagtgcagcgccctgttgaagaagtggctgccagaccgatgcgcatcattcgcggataagatacagtccgaagtccataatataaaaggtctcgcaggtgatcgcctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11964 - DNA, 810 bp, Artificial Sequence
  Synthetic Polynucleotide
atggccttaccagtgaccgccttgctcctgccgctggccttgctgctccacgccgccaggccgatggccacaatcaatgaaaatttcgaagacatcgaccttgtcgcgattggaggctcatttgctacagatgtggacgccaacaggggtggtcatggtggacatccgggcaaaaagatgcctaaagaggtcttgttggaaatggaagcgaacgcaaaacgagccggatgtcataggggttgtttgatttgtctttctcacatcaaatgtacgcagaagatgaagaaattcataccgggacggtgtcactcctatgctggtgacaaggatagcgctcagggcggcataacagaggaggagactgttgacatgcccgagatcgctgggttcaaggatcttgaacctatggagcagtttattgcacaggtagacttgtgcgttgactgcacaactggttgtttgaaagggctggccaacgtccactgttctgacttgctcaaaaagtggctgccttcccggtgcaagacttttgcctcaaaaattcagagtcaggttgacaccatcaaggggttggctggtgacaggctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11965 - DNA, 867 bp, Artificial Sequence
  Synthetic Polynucleotide
atggccttaccagtgaccgccttgctcctgccgctggccttgctgctccacgccgccaggccgatgaatcctacagagaacaatgatcatatcaatattgtcgggatcgagggtaaattcggaatcacagacttggagacggatctcttcactatctgggagacaaatcgcatgatttctaccgataacgaacaggcaaatacagacagtaatagagggaagatgccaggtaagaaactgccattggcagttcttatagagatggaagccaacgctttcaaggcgggttgtacaagaggctgtctcatttgcttgtctaaaatcaagtgtactgctaagatgaagaaatacataccgggaagatgccatgactacggaggtgataagaagactgggcaggcaggaatcgtgggcgcgattgtcgacatacccgacatatccgggttcaaggaaatgggaccgatggagcaattcatcgcccaagtggatcgatgcaccgactgcacaacgggatgtttgaagggtcttgcaaatgttaagtgctccgagctgttgaagaagtggttgccggaccgctgcgcgagtttcgccgataaaattcaaagtgaggtgcataatattaaaggtctggcgggagatcgcctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11966 - DNA, 786 bp, Artificial Sequence
  Synthetic Polynucleotide
atggccttaccagtgaccgccttgctcctgccgctggccttgctgctccacgccgccaggccgatgcaacccactgagaataaaaaggaatcctataccgaagacacagacgtaaacggggaccatgatcgaggcaggaagcttccggggaagaaacttccactggaagttctgaaaatcatggaagctaacgcaaggagagcaggttgcacgcgaggctgtttgatatgtcttagcaagataaaatgtactgcaaaaatgaagcaatacataccgggaagatgccatacttatgagggggacaaaagcatagggcaggcaggcataggaggcccaatcattgatataccggaaattatagggtttaagaacatggaaccaatggaacagttcatcgcacaggtggatctctgtgcggactgcactactggatgcctcaaaggtctcgcaaatgtaagatgcaacgatcttttgaaaaaatggttgccagatcgatgcgcggggttcgcactcaagatacaaggtgaagtggaaaacataaaggggatggccggggatcgactcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11967 - DNA, 906 bp, Artificial Sequence
  Synthetic Polynucleotide
atggccttaccagtgaccgccttgctcctgccgctggccttgctgctccacgccgccaggccgatgcttccagcgtcacccaccgataggtcaatagtccttgacaacggctatgtgtgttcctgggagggtatcccagacgacctgcgggactgtccgaagacagaggatatgtctaagcagcacggagctgctctcaaactgccgccagatgtgttggatgagatggaatgtaatgctaaaaagagtggatgcgtgcgaggatgtcttcagtgtctggcactcataaaatgtactgcaaaaatgagaaagtatatccccggacgctgtcatagctacgagggtgacaaggacattgctcagggggggatcggaaaggaactgacaattgacatccctgagattcctggcttcttggatcttgcaccaatggaccagttcgtggcgcaggtcgacctctgcgtggactgcagcagtcggtgcctgaagggcttggctaatgtccaatgcagttgtaagctctacaaatggttgccaacccggtgtaccggcttccaagcgaaaataaagaaagaagctgacacggtaattgggctggaagatgcgctcgcactcggattcgacaccatccaggcatgcgtagcggccggtaaatgcaaggatacggttggccggtactctctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11968 - DNA, 822 bp, Artificial Sequence
  Synthetic Polynucleotide
atggccttaccagtgaccgccttgctcctgccgctggccttgctgctccacgccgccaggccgatgtgggcggcctccgaggaggccgatgacgacctcgtatctttggtcaaaaactactggggcgtaggcgtaagcaatgaacgcgatgtatctctcgacagggggggccatggcaagctgccgaaaaagcttagcgttgagattctcgctgaaatggaagcaaacgcccagaagagtaattgctctcgggggtgtctgatagggctttctaaaattaaatgcacgcccaaaatgaaaaaattcctccctggcaggtgccacgaatactctggtgatcccaaaactggacagggtccgcttactgcggctgcggttataccagggtatagtgatcttacagctatggagcagttcaagctccaagtagacaagtgtgactgttcaactcaatgtcttaagggtcttgcaaatgtcaagtgctcagcggccctcaaagcggtgttgccaacaagatgctcacaattcgcaactcagatccaagctgaagtaggcaccataaaagggaaggggaagaaaccgactccaccgataggtctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11969 - DNA, 867 bp, Artificial Sequence
  Synthetic Polynucleotide
atggccttaccagtgaccgccttgctcctgccgctggccttgctgctccacgccgccaggccgatgaaacccactgaaatcaatgaagacctcaatatagctgctgtggcctccaactttgccaccacagatcttgagactgacctgttcaccaactgggagaccatgaatgtgattagcactgacacagagcaggtgaacacagatgctgacaggggcaagctgcctggcaaaaaactccccccagatgtcctgagggagctggaggccaatgccagaagggctggttgcacaagaggctgcctcatttgcctctcccacattaagtgcacccctaagatgaagaaatttatccctggcaggtgccacacttatgaaggtgaaaaggagtctgctcagggagggattggagaggcaattgttgatatcccagagattcctggcttcaaggataaggagccactggaccagtttattgctcaagtggacctctgtgctgattgcaccactggctgtctgaagggccttgccaatgtccagtgctctgacctcctgaagaagtggcttccccagaggtgtaccacttttgccagcaagattcagggtagggtggacaaaatcaagggtctggctggggacagactcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11970 - DNA, 1221 bp, Artificial Sequence
  Synthetic Polynucleotide
atggccttaccagtgaccgccttgctcctgccgctggccttgctgctccacgccgccaggccgatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11971 - DNA, 1938 bp, Artificial Sequence
  Synthetic Polynucleotide
atggccttaccagtgaccgccttgctcctgccgctggccttgctgctccacgccgccaggccgatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11972 - DNA, 1920 bp, Artificial Sequence
  Synthetic Polynucleotide
atggccttaccagtgaccgccttgctcctgccgctggccttgctgctccacgccgccaggccgatggccgacaagaacatcctgtacggccccgagcctttctaccctctggaagatggaacagccggcgagcagatgttcgacgccctgagcagatatgccgccattcctggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacagcctccagttcttcctgcctgtgatcgccagcctgtacctgggcattattgtggcccctgtgaacgacaagtacatcgagagagagctgatccacagcctgggcatcgtgaagccccggatcgtgttctgctccaagaacaccttccagaaggtgctgaacgtcaagagcaagctgaagtccatcgagacaatcatcatcctggacctgaacgaggacctcggcggctaccagtgcctgaacaacttcatcagccagaacagcgacagcaacctggacgtgaagaagttcaagccctacagcttcaaccgggacgaccaggtggcctccatcatgtttagcagcggcaccaccggactgcccaaaggcgttatgctgacccacaagaatatcgtggcccggttctctatcgctaaggaccccaccttcggcaacgccatcaatcctacaagcgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggccttcctggctaagtctgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaagggcgacgccaagcctggcagcacaggcaaaattgtgcctctgcacgccgtgaaggtggtggaccctaccacaggcaagatcctgggacctaatgagcccggcgagctgtacttcaagggacccatgattatgaagggctactacaacaacgaggaagccaccaaggccattatcgacaacgacggctggctgcggagcggcgatattgcctactacgacaatgacggccacttctacatcgtggacagactgaagtccctcatcaagtacaagggctatcaggtggccccagccgagatcgagggtatcctgctgcaacacccctatatcgtggatgccggcgtgacaggcatccctgatgaagctgctggcgaacttccagcagctggcgtggtggttcagaccggcaagtacctgaatgagcagatcgtgcaggactacgtggcctctcaggtgtccacagccaaatggctgagaggcggcgtgaagttcctggacgagatcccaaagggctctaccggcaagatcgacagaaaggtgctgcggcagatgctggaaaagcacaccaatggcctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11973 - DNA, 1920 bp, Artificial Sequence
  Synthetic Polynucleotide
atggccttaccagtgaccgccttgctcctgccgctggccttgctgctccacgccgccaggccgatggccgacaagaacatcctgtacggccccgagcctttctaccctctggaagatggaacagccggcgagcagatgttcgacgccctgagcagatacgccgacattcctggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacagcctccagttcttcctgcctgtgatcgccagcctgtacctgggcattattgtggcccctgtgaacgacaagtacatcgagagagagctgatccacagcctgggcatcgtgaagccccggatcgtgttctgctccaagaacaccttccagaaggtgctgaacgtcaagagcaagctgaagtccatcgagacaatcatcatcctggacctgaacgacgacctcggcggctaccagtgcctgaacaacttcatcagccagaacagcgacagcaacctggacgtgaagaagttcaagccctacagcttcaaccgggacgaccaggtggccctgattatgtttagcagcggcaccaccggactgcccaaaggcgttatgctgacccacaagaatatcgtggcccggttctctatcgctaaggaccccaccttcggcaacgccatcaatcctacaagcgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggccttcctggctaagtctgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaagggcgacgccaagcctggcagcacaggcaagattgtgcctttccacgccgtgaaggtggtggaccctaccaccggaaagatcctgggacctaatgagcccggcgagctgtacttcaagggacccatgattatgaagggctactacaacaacgaggaagccaccaaggccattatcgacaacgacggctggctgcggagcggcgatattgcctactacgacaatgacggccacttctacatcgtggacagactgaagtccctcatcaagtacaagggctaccaggtcgcccctgccgagattgagggtatcctgctgcaacacccctatatcgtggatgccggcgtgacaggcatccctgatgaagctgctggcgaacttccagcagctggcgtggtggttcagaccggcaagtacctgaatgagcagatcgtgcaggactacgtggcctctcaggtgtccacagccaaatggctgagaggcggcgtgatcttcctggacgagatcccaaagggctctaccggcaagatcgacagaaaggtgctgcggcagatgctggaaaagcacaccaatggcctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11974 - DNA, 1920 bp, Artificial Sequence
  Synthetic Polynucleotide
atggccttaccagtgaccgccttgctcctgccgctggccttgctgctccacgccgccaggccgatggccgacaagaacatcctgtacggccccgagcctttctaccctctggctgatggaacagccggcgagcagatgttcgatgccctgagcagatacgccgacatcagcggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacggcctccagttctttctgcctgtgatcgccagcctgtacctgggcattatcgctgcccctgtgtccgataagtacatcgagagagagctgatccacagcctgggcatcgtgaagccccggatcatcttctgctccaagaacaccttccagaaggtgctgaacgtcaagagcaagctgaagtccgtggaaaccatcatcatcctggacctgaacgaggacctcggcggctaccagtgcctgaacaacttcatctctcagaacagcgacagcaacctggacgtgaagaagttcaagccctacagcttcaaccgggacgaccaggtggccctggtcatgtttagctctggcacaaccggcgtgcccaagggcgttatgctgacccacaagaatatcgtggcccggttcagcctggctaaggaccctaccttcggcaacgccatcaatcccaccaccgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggcctttctggccaagtctgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaagggcgacgctagacctggcagcacaggcaagatcgtgcctttccacgccgtgaaggtggtggaccctacaaccggcaagatcctgggacctaatgagcccggcgagctgtactttaagggcgccatgattatgaagggctactacaacaacgaggaagccaccaaggccattatcgacaacgacggctggctgcggagcggcgatattgcctactacgacaatgacggccacttctacatcgtggacagactgaagtccctcatcaagtacaagggctaccaggtcgcccctgccgagattgagggtatcctgctgcaacacccctatatcgtggatgccggcgtgacaggcatccctgatgaagctgctggcgaacttccagcagcaggcgtggtggttcagaccggcaagtacctgaatgagcagatcgtgcaggacttcgtgtccagccaggtgtccacagccaaatggctgagaggcggcgtgaagttcctggacgagatcccaaagggctccaccggaaagatcgacagaaaggtgctgcggcagatgtttgagaagcacaccaacggcctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11975 - DNA, 1920 bp, Artificial Sequence
  Synthetic Polynucleotide
atggccttaccagtgaccgccttgctcctgccgctggccttgctgctccacgccgccaggccgatggccgacaagaacatcctgtacggccccgagcctttctaccctctggctgatggaacagccggcgagcagatgttctacgccctgagcagatacgccgacatcagcggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacggcctccagttcttcctgcctatcattgccagcctgtacctgggcatcattgctgcccctgtgtccgataagtacatcgagagagagctgatccactctctgggcatcgtgaagccccggatcatcttctgctccaagaacaccttccagaaggtgctgaacgtcaagagcaagctgaaatacgtggaaaccatcatcatcctggacctgaacgaggacctcggcggctaccagtgcctgaacaacttcatctctcagaacagcgacatcaacctggacgtcaagaagttcaagccctacagcttcaaccgggacgaccaggtggccctggtcatgtttagctctggcacaaccggcgtgtccaagggcgtgatgctgacccacaagaatatcgtggcccggttcagcctggctaaggaccctaccttcggcaacgccatcaatcccaccaccgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggcctttctggctaagagcgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaacaacgatgtgcggcctggcagcacaggcaagatcgtgccttttcacgccgtgaaggtggtggaccctacaaccggcaagatcctgggacctaatgagcccggcgagctgtacttcaagggcgacatgattatgaagggctactacaacaacgaggaagccaccaaggccattatcaacaaggacggctggctgcggagcggcgacattgcctactatgacaacgacggccacttctacatcgtggaccggctgaagtccctgattaagtacaagggctaccaggtcgcccctgccgagattgagggtatcctgctgcaacacccctatatcgtggatgccggcgtgacaggcatccctgatgaagctgctggcgaacttccagcagctggcgtggtggttcagaccggcaagtacctgaatgagcagatcgtgcagaatttcgtgtccagccaggtgtccaccgccaagtggcttagaggcggcgtgaagttcctggacgagatccctaaaggctccaccggaaagatcgacagaaaggtgctgcgccagatgttcgagaagcacaccaatggcctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11976 - DNA, 1914 bp, Artificial Sequence
  Synthetic Polynucleotide
atggccttaccagtgaccgccttgctcctgccgctggccttgctgctccacgccgccaggccgatgatgaagcgcgagaagaacgtgatctacggccccgaacctctgcaccctcttgaggatcttacagccggcgagatgctgttcagagccctgcggaaacacagccatctgcctcaggctctggtggatgtcgtgggagatgagagcctgtcctacaaagagttcttcgaggccaccgtgctgctggcccagtctctgcataattgcggctacaagatgaacgacgtggtgtccatctgcgccgagaacaacacccggttcttcatccctgtgatcgccgcctggtacatcggcatgattgtggcccctgtgaacgagagctacatccccgacgagctgtgcaaagtgatgggcatcagcaagccccagatcgtgttcaccaccaagaacatcctgaacaaggtgctggaagtgcagagccggaccaacttcatcaagcggatcatcatcctggacaccgtggaaaacatccacggctgcgagagcctgccaaacggcatctccagatacagcgacggcaatatcgccaacttcaagcccctgcacttcgaccccgtggaacaggtggcagccatcctgtgtagcagcggcacaacaggactgcccaaaggcgtgatgcagacccaccagaatatctgcgtgcggctgatccacgctctggaccctagagctggaacccagctgattcctggcgtgaccgtgctggtgtacctgcctttctttcacgccttcggcttcagcatcaccctgggctacttcatggtcggactgagagtgattatgtttcggcgcttcgaccaagaagccttcctgaaggccatccaggactacgaagtgcgctccgtgattaacgtgcccagcgtgatcctgttcctgagcaagagcccactggtggataagtacgacctgagcagcctgagagagctgtgttgcggagctgcccctctggctaaagaggtggcagaagttgccgccaagcggctgaatctgcctggcatcagatgtggctttggcctgaccgagagcaccagcgccaatatccacagcctgcgggacgagtttaagagcggctctctgggcagagtgacccctctgatggccgccaagatcgccgatagagagacaggcaaagccctgggacctaatcaagtgggcgagctgtgtatcaagggacctatggtgtccaagggctacgtgaacaacgtggaagccaccaaagaggccatcgacgacgacggctggctgcactctggcgatttcggctactacgacgaggacgagcacttctacgtggtggacagatacaaagagctgattaagtacaagggcagccaggtggccccagccgagctggaagaaatcctgctgaagaacccctgcatccgcgacgtggcagttgtgggcattcctgatctggaagccggcgaactgcctagcgcctttgtggttaagcagcccggcaaagagatcaccgccaaagaggtgtacgactacctggccgagagagtgtcccacaccaagtatctgagaggcggcgtcagattcgtggacagcatccccagaaacgtgaccggcaagatcacccggaaagagctgctgaaacagctgctggaaaaggctggcggactcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11977 - DNA, 1914 bp, Artificial Sequence
  Synthetic Polynucleotide
atggccttaccagtgaccgccttgctcctgccgctggccttgctgctccacgccgccaggccgatggtaaagcgtgagaaaaatgtcatctatggccctgagcctctccatcctttggaggatttgactgccggcgaaatgctgtttcgtgctctccgcaagcactctcatttgcctcaagccttggtcgatgtggtcggcgatgaatctttgagctacaaggagttttttgaggcaaccgtcttgctggctcagtccctccacaattgtggctacaagatgaacgacgtcgttagtatctgtgctgaaaacaatacccgtttcttcattccagtcatcgccgcatggtatatcggtatgatcgtggctccagtcaacgagagctacattcccgacgaactgtgtaaagtcatgggtatctctaagccacagattgtcttcaccactaagaatattctgaacaaagtcctggaagtccaaagccgcaccaactttattaagcgtatcatcatcttggacactgtggagaatattcacggttgcgaatctttgcctaatttcatctctcgctattcagacggcaacatcgcaaactttaaaccactccacttcgaccctgtggaacaagttgcagccattctgtgtagcagcggtactactggactcccaaagggagtcatgcagacccatcaaaacatttgcgtgcgtctgatccatgctctcgatccacgctacggcactcagctgattcctggtgtcaccgtcttggtctacttgcctttcttccatgctttcggctttcatattactttgggttactttatggtcggtctccgcgtgattatgttccgccgttttgatcaggaggctttcttgaaagccatccaagattatgaagtccgcagtgtcatcaacgtgcctagcgtgatcctgtttttgtctaagagcccactcgtggacaagtacgacttgtcttcactgcgtgaattgtgttgcggtgccgctccactggctaaggaggtcgctgaagtggccgccaaacgcttgaatcttccagggattcgttgtggcttcggcctcaccgaatctaccagtgcgattatccagactctcggggatgagtttaagagcggctctttgggccgtgtcactccactcatggctgctaagatcgctgatcgcgaaactggtaaggctttgggcccgaaccaagtgggcgagctgtgtatcaaaggccctatggtgagcaagggttatgtcaataacgttgaagctaccaaggaggccatcgacgacgacggctggttgcattctggtgattttggatattacgacgaagatgagcatttttacgtcgtggatcgttacaaggagctgatcaaatacaagggtagccaggttgctccagctgagttggaggagattctgttgaaaaatccatgcattcgcgatgtcgctgtggtcggcattcctgatctggaggccggcgaactgccttctgctttcgttgtcaagcagcctggtacagaaattaccgccaaagaagtgtatgattacctggctgaacgtgtgagccatactaagtacttgcgtggcggcgtgcgttttgttgactccatccctcgtaacgtaacaggcaaaattacccgcaaggagctgttgaaacaattgttggtgaaggccggcggtctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11978 - DNA, 1758 bp, Artificial Sequence
  Synthetic Polynucleotide
atggccttaccagtgaccgccttgctcctgccgctggccttgctgctccacgccgccaggccgatgatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtatgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccgggtctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11979 - DNA, 996 bp, Artificial Sequence
  Synthetic Polynucleotide
atggccttaccagtgaccgccttgctcctgccgctggccttgctgctccacgccgccaggccgatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11980 - DNA, 1005 bp, Artificial Sequence
  Synthetic Polynucleotide
atggccttaccagtgaccgccttgctcctgccgctggccttgctgctccacgccgccaggccgatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 11981 - skipped

SEQ ID NO: 11982 - DNA, 837 bp, Artificial Sequence
  Synthetic Polynucleotide
atgaactccttctccacaagcgccttcggtccagttgccttctccctgggcctgctcctggtgttgcctgctgccttccctgccccagtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11983 - DNA, 810 bp, Artificial Sequence
  Synthetic Polynucleotide
atggccttaccagtgaccgccttgctcctgccgctggccttgctgctccacgccgccaggccgatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11984 - DNA, 816 bp, Artificial Sequence
  Synthetic Polynucleotide
atggccttaccagtgaccgccttgctcctgccgctggccttgctgctccacgccgccaggccgatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11985 - DNA, 747 bp, Artificial Sequence
  Synthetic Polynucleotide
atggccttaccagtgaccgccttgctcctgccgctggccttgctgctccacgccgccaggccgatggaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11986 - DNA, 762 bp, Artificial Sequence
  Synthetic Polynucleotide
atggccttaccagtgaccgccttgctcctgccgctggccttgctgctccacgccgccaggccgatgaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11987 - DNA, 921 bp, Artificial Sequence
  Synthetic Polynucleotide
atggccttaccagtgaccgccttgctcctgccgctggccttgctgctccacgccgccaggccgatgctgcctgccagccccaccgacagatccatcgtgctggacaacggctacgtgtgcagctgggagggcatccccgacgacctgagagactgccccaagaccgaggacatgagcaagcagcatggcgctgccctgaagctgccccccgatgtgctggacgagatggaatgcaacgccaagaaaagcggctgcgtgcggggctgcctccagtgtctggccctgattaagtgcaccgccaagatgcggaagtacatccccggcagatgccacagctacgagggcgacaaggacattgcccagggcggcatcggcaaagagctgaccatcgacatccccgagatccccggcttcctggacctggcccctatggatcagttcgtggcccaggtggacctgtgcgtggactgctccagcagatgcctgaagggcctggctaacgtgcagtgctcctgcaagctgtataagtggctgcccaccagatgcaccggcttccaggccaagatcaagaaagaggccgacaccgtgatcggactggaagatgccctggccctgggcttcgacaccatccaggcttgtgtggccgctggcaagtgcaaggacaccgtgggcagatacagcctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11988 - DNA, 810 bp, Artificial Sequence
  Synthetic Polynucleotide
atggccttaccagtgaccgccttgctcctgccgctggccttgctgctccacgccgccaggccgatggccgcctctgaagaggccgatgacgatcacgtgtccctcgtgaagaactactggcggatcggcgtgggcaacgagcgggatgtgtctctggatagaggcggccctcccaagctgagcaaagaactgctggccgagatgcacgccattgccagcaatgccggctgctccagagtgtgcctgatcggcctgagcaagatcaagtgcacccccaagatgaagaccttcctgcccggcagatgcaacaccttcgcccctaaacctgccaccggcgacggaccttttgccgccgctgctgccatccctggcttcagcgatctgaccgctatggaacagtacaaggcccaggtggcccagtgcgactgctccaacagatgcctcgtgggcctggctaacatcaagtgttctgccgccctgaaggccgccctgcctcagagatgtaccacctttgccaccaacatccagaaagagggcgaggtggacagcatcaagggctacggcagaaagctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11989 - DNA, 888 bp, Artificial Sequence
  Synthetic Polynucleotide
atggccttaccagtgaccgccttgctcctgccgctggccttgctgctccacgccgccaggccgatgcagcccaccgagaacaagcaggaaagccagatcgaggacatcgacagaagcaccagcctgggcctgatgtgctacgagcagtgtacaggccagagcggcctggatctgaagtgctacaaagagtgcgccgacttcaccggcgaccggaacagaggcagaaagctgcccggcaagaaactgcccctggaagtgctgaagatcatggaagccaacgccagaagggccggctgcaccagaggctgcctgatctgcctgagcaagatcaagtgcaccgccaagatgaagcagtacatccccggcagatgccacacctacgagggcgacaagtctatcggccagggcggcatcggaggccccatcgtggatatccctgagatcatcggcttccagaacatggaacctatggaacagtttatcgcccaggtggacctgtgcgccgattgcacaaccggctgtctgaagggcctggctaacgtgcggtgcaacgacctgctgaagaagtggctgcccgacagatgcgccggcttcgccaacaagatccagagcgaggtggacaacatcaagggactggccggcgacagactcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11990 - DNA, 813 bp, Artificial Sequence
  Synthetic Polynucleotide
atggccttaccagtgaccgccttgctcctgccgctggccttgctgctccacgccgccaggccgatgaagagcatagacagctacgaaaatattgatatagtggctgttgcgggcaacttcgctgctgttgaccaggacgctaaccgcggaggaaacctgccgggtaagaaaatgccaatagaggttcttaaagaaatggaagctaacgccaagcgagcagggtgtgttcggggctgtttgatatgcttgtcccacatcaaatgcacagctaaaatgaaaaaattcataccaggtcggtgtcatagctatcatggagatgcagatacgaagcaaggggcacttgaagaagtggttgacatgcccgagataccgggatttgtggacatggagcccatggaacagtttatagcccaggtggataaatgcgaggactgtaccactggttgtttgaaaggtctcgccaacgtccactgcagcgatctcctcaagaaatggctgccgcaaagatgctcacagtttgcggataagatccaatccgaggtggacacaataaagggcctggcaggggaccggctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11991 - DNA, 882 bp, Artificial Sequence
  Synthetic Polynucleotide
atggccttaccagtgaccgccttgctcctgccgctggccttgctgctccacgccgccaggccgatgaacccgacggagaacaaggacgatattgatattgtgggagtggaaggcaaattcgggactacggatcttgaaactgatctctttacgattgttgaggacatgaacgtaatctcaagggatacgaacctggcaaatagtgacgcagaccgaggcaaaatgccgggaaaaaaacttccgttggaagtactgatcgagatggaagcgaatgcacgcaaggcagggtgtacacggggatgcttgatctgtctgagtaagattaaatgcaccgctaaaatgaaagtttatatacccggtcggtgccacgattatgggggcgataagaaaaccggtcaggcagggatcgtcggagcaatcgtggatattcctgaaatttcaggattcaaagaacttggaccaatggagcaatttatagcacaagtggacctctgcgctgactgcacgacgggatgtctgaaaggtcttgcaaatgtaaagtgttcagcactccttaagaaatggcttcccgaccgatgtgcctcttttgctgacaagattcagtctgaagttgataacataaagggtcttgcgggtgatcggctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11992 - DNA, 813 bp, Artificial Sequence
  Synthetic Polynucleotide
atggccttaccagtgaccgccttgctcctgccgctggccttgctgctccacgccgccaggccgatgaagcctaccgaaaataatgatgatattgatatagttgggatcgcaagtacatttatcacgacaaacaccgacgcggaccggggcaagatgccgggaaagaaacttcccttggcagtcctcaaggaaatggaggcgaacgctgcaaaggcagggtgttccagaggttgtctgatctgcttgtctaaaatcaagtgtacagctaagatgaagcagtttattccggggcgctgtcacgactacggtggtgataaaaaaacgggccaggcggcgctggtcggagcaatattcgacatccctgaaatcttcggatttctcgatatggaacctatcgagcagttcatagcacaagtagatttgtgtgctggctgcacaacaggctgcttgaaaggactcgcaaatattaagtgttctgaactcttgaagaagtggcttccgaaaagatgtacctccttcgcgtataaaatgcaaaaggaaatgcacaatataaaaggcatggcaggagatcggctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11993 - DNA, 813 bp, Artificial Sequence
  Synthetic Polynucleotide
atggccttaccagtgaccgccttgctcctgccgctggccttgctgctccacgccgccaggccgatgaaagcgaccgaaaacaatgacgacatagacatagttggaatcgcgtcaaccttcataacgacaaacacggacgccgaccgaggcaaaatgccggggaaaagattgccactggcggtgttgaaagagatggaagcgaacgcagtcaaagcgggatgtagcaggggctgccttatatgtctgagtaagattaaatgcaccgcgaagatgaagcaatacatccccggcaggtgccacgattacggaggagacaagaagaccgggcaggcggctatagagggcgcgatagatgatattcctgaaatctctggctttaaggagatggcgcctatggagcaattcattgcgcaggttgacttgtgcgcagactgcacgacaggatgcctcaagggcttggcaaatgtaaaatgttccgaacttctgaaaaaatggctgcccaagaggtgtacctccttcgccacgaagatgcaaaaggagatccataacatcaaaggcatggggggggaccgcctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11994 - DNA, 891 bp, Artificial Sequence
  Synthetic Polynucleotide
atggccttaccagtgaccgccttgctcctgccgctggccttgctgctccacgccgccaggccgatgaaccctacggagacccaggacggagtggacattctcggcgtggaagggaaattcgggacagaaaccaacttggagactgatctgtttaccatttgggagataaatggaataattaaatctgatcgcgacacaaatagggcaaatgcagacgctgatcgaggaaaaatgcccggcaagaaacttcctttggcggtgctcatagagatggaggcaaacgcattcaaagcgggttgcactcgcggttgtctcatttgtttgtccaaaatcaaatgcacggctaagatgaaagagtatatcccaggacggtgccatgattacggtggggataaaaaaacgggacaagcaggtatagtaggtgctatcgtggacattccagaaatctcaggatttaaagagcttggccccatggagcaattcatagcgcaagtagacctttgcgctgattgcactactggctgtcttaagggactggcgaatgttaagtgcagcgccctgttgaagaagtggctgccagaccgatgcgcatcattcgcggataagatacagtccgaagtccataatataaaaggtctcgcaggtgatcgcctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11995 - DNA, 825 bp, Artificial Sequence
  Synthetic Polynucleotide
atggccttaccagtgaccgccttgctcctgccgctggccttgctgctccacgccgccaggccgatggccacaatcaatgaaaatttcgaagacatcgaccttgtcgcgattggaggctcatttgctacagatgtggacgccaacaggggtggtcatggtggacatccgggcaaaaagatgcctaaagaggtcttgttggaaatggaagcgaacgcaaaacgagccggatgtcataggggttgtttgatttgtctttctcacatcaaatgtacgcagaagatgaagaaattcataccgggacggtgtcactcctatgctggtgacaaggatagcgctcagggcggcataacagaggaggagactgttgacatgcccgagatcgctgggttcaaggatcttgaacctatggagcagtttattgcacaggtagacttgtgcgttgactgcacaactggttgtttgaaagggctggccaacgtccactgttctgacttgctcaaaaagtggctgccttcccggtgcaagacttttgcctcaaaaattcagagtcaggttgacaccatcaaggggttggctggtgacaggctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11996 - DNA, 882 bp, Artificial Sequence
  Synthetic Polynucleotide
atggccttaccagtgaccgccttgctcctgccgctggccttgctgctccacgccgccaggccgatgaatcctacagagaacaatgatcatatcaatattgtcgggatcgagggtaaattcggaatcacagacttggagacggatctcttcactatctgggagacaaatcgcatgatttctaccgataacgaacaggcaaatacagacagtaatagagggaagatgccaggtaagaaactgccattggcagttcttatagagatggaagccaacgctttcaaggcgggttgtacaagaggctgtctcatttgcttgtctaaaatcaagtgtactgctaagatgaagaaatacataccgggaagatgccatgactacggaggtgataagaagactgggcaggcaggaatcgtgggcgcgattgtcgacatacccgacatatccgggttcaaggaaatgggaccgatggagcaattcatcgcccaagtggatcgatgcaccgactgcacaacgggatgtttgaagggtcttgcaaatgttaagtgctccgagctgttgaagaagtggttgccggaccgctgcgcgagtttcgccgataaaattcaaagtgaggtgcataatattaaaggtctggcgggagatcgcctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11997 - DNA, 801 bp, Artificial Sequence
  Synthetic Polynucleotide
atggccttaccagtgaccgccttgctcctgccgctggccttgctgctccacgccgccaggccgatgcaacccactgagaataaaaaggaatcctataccgaagacacagacgtaaacggggaccatgatcgaggcaggaagcttccggggaagaaacttccactggaagttctgaaaatcatggaagctaacgcaaggagagcaggttgcacgcgaggctgtttgatatgtcttagcaagataaaatgtactgcaaaaatgaagcaatacataccgggaagatgccatacttatgagggggacaaaagcatagggcaggcaggcataggaggcccaatcattgatataccggaaattatagggtttaagaacatggaaccaatggaacagttcatcgcacaggtggatctctgtgcggactgcactactggatgcctcaaaggtctcgcaaatgtaagatgcaacgatcttttgaaaaaatggttgccagatcgatgcgcggggttcgcactcaagatacaaggtgaagtggaaaacataaaggggatggccggggatcgactcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11998 - DNA, 921 bp, Artificial Sequence
  Synthetic Polynucleotide
atggccttaccagtgaccgccttgctcctgccgctggccttgctgctccacgccgccaggccgatgcttccagcgtcacccaccgataggtcaatagtccttgacaacggctatgtgtgttcctgggagggtatcccagacgacctgcgggactgtccgaagacagaggatatgtctaagcagcacggagctgctctcaaactgccgccagatgtgttggatgagatggaatgtaatgctaaaaagagtggatgcgtgcgaggatgtcttcagtgtctggcactcataaaatgtactgcaaaaatgagaaagtatatccccggacgctgtcatagctacgagggtgacaaggacattgctcagggggggatcggaaaggaactgacaattgacatccctgagattcctggcttcttggatcttgcaccaatggaccagttcgtggcgcaggtcgacctctgcgtggactgcagcagtcggtgcctgaagggcttggctaatgtccaatgcagttgtaagctctacaaatggttgccaacccggtgtaccggcttccaagcgaaaataaagaaagaagctgacacggtaattgggctggaagatgcgctcgcactcggattcgacaccatccaggcatgcgtagcggccggtaaatgcaaggatacggttggccggtactctctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 11999 - DNA, 837 bp, Artificial Sequence
  Synthetic Polynucleotide
atggccttaccagtgaccgccttgctcctgccgctggccttgctgctccacgccgccaggccgatgtgggcggcctccgaggaggccgatgacgacctcgtatctttggtcaaaaactactggggcgtaggcgtaagcaatgaacgcgatgtatctctcgacagggggggccatggcaagctgccgaaaaagcttagcgttgagattctcgctgaaatggaagcaaacgcccagaagagtaattgctctcgggggtgtctgatagggctttctaaaattaaatgcacgcccaaaatgaaaaaattcctccctggcaggtgccacgaatactctggtgatcccaaaactggacagggtccgcttactgcggctgcggttataccagggtatagtgatcttacagctatggagcagttcaagctccaagtagacaagtgtgactgttcaactcaatgtcttaagggtcttgcaaatgtcaagtgctcagcggccctcaaagcggtgttgccaacaagatgctcacaattcgcaactcagatccaagctgaagtaggcaccataaaagggaaggggaagaaaccgactccaccgataggtctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 12000 - DNA, 882 bp, Artificial Sequence
  Synthetic Polynucleotide
atggccttaccagtgaccgccttgctcctgccgctggccttgctgctccacgccgccaggccgatgaaacccactgaaatcaatgaagacctcaatatagctgctgtggcctccaactttgccaccacagatcttgagactgacctgttcaccaactgggagaccatgaatgtgattagcactgacacagagcaggtgaacacagatgctgacaggggcaagctgcctggcaaaaaactccccccagatgtcctgagggagctggaggccaatgccagaagggctggttgcacaagaggctgcctcatttgcctctcccacattaagtgcacccctaagatgaagaaatttatccctggcaggtgccacacttatgaaggtgaaaaggagtctgctcagggagggattggagaggcaattgttgatatcccagagattcctggcttcaaggataaggagccactggaccagtttattgctcaagtggacctctgtgctgattgcaccactggctgtctgaagggccttgccaatgtccagtgctctgacctcctgaagaagtggcttccccagaggtgtaccacttttgccagcaagattcagggtagggtggacaaaatcaagggtctggctggggacagactcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 12001 - DNA, 1236 bp, Artificial Sequence
  Synthetic Polynucleotide
atggccttaccagtgaccgccttgctcctgccgctggccttgctgctccacgccgccaggccgatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 12002 - DNA, 1953 bp, Artificial Sequence
  Synthetic Polynucleotide
atggccttaccagtgaccgccttgctcctgccgctggccttgctgctccacgccgccaggccgatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 12003 - DNA, 1935 bp, Artificial Sequence
  Synthetic Polynucleotide
atggccttaccagtgaccgccttgctcctgccgctggccttgctgctccacgccgccaggccgatggccgacaagaacatcctgtacggccccgagcctttctaccctctggaagatggaacagccggcgagcagatgttcgacgccctgagcagatatgccgccattcctggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacagcctccagttcttcctgcctgtgatcgccagcctgtacctgggcattattgtggcccctgtgaacgacaagtacatcgagagagagctgatccacagcctgggcatcgtgaagccccggatcgtgttctgctccaagaacaccttccagaaggtgctgaacgtcaagagcaagctgaagtccatcgagacaatcatcatcctggacctgaacgaggacctcggcggctaccagtgcctgaacaacttcatcagccagaacagcgacagcaacctggacgtgaagaagttcaagccctacagcttcaaccgggacgaccaggtggcctccatcatgtttagcagcggcaccaccggactgcccaaaggcgttatgctgacccacaagaatatcgtggcccggttctctatcgctaaggaccccaccttcggcaacgccatcaatcctacaagcgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggccttcctggctaagtctgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaagggcgacgccaagcctggcagcacaggcaaaattgtgcctctgcacgccgtgaaggtggtggaccctaccacaggcaagatcctgggacctaatgagcccggcgagctgtacttcaagggacccatgattatgaagggctactacaacaacgaggaagccaccaaggccattatcgacaacgacggctggctgcggagcggcgatattgcctactacgacaatgacggccacttctacatcgtggacagactgaagtccctcatcaagtacaagggctatcaggtggccccagccgagatcgagggtatcctgctgcaacacccctatatcgtggatgccggcgtgacaggcatccctgatgaagctgctggcgaacttccagcagctggcgtggtggttcagaccggcaagtacctgaatgagcagatcgtgcaggactacgtggcctctcaggtgtccacagccaaatggctgagaggcggcgtgaagttcctggacgagatcccaaagggctctaccggcaagatcgacagaaaggtgctgcggcagatgctggaaaagcacaccaatggcctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 12004 - DNA, 1935 bp, Artificial Sequence
  Synthetic Polynucleotide
atggccttaccagtgaccgccttgctcctgccgctggccttgctgctccacgccgccaggccgatggccgacaagaacatcctgtacggccccgagcctttctaccctctggaagatggaacagccggcgagcagatgttcgacgccctgagcagatacgccgacattcctggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacagcctccagttcttcctgcctgtgatcgccagcctgtacctgggcattattgtggcccctgtgaacgacaagtacatcgagagagagctgatccacagcctgggcatcgtgaagccccggatcgtgttctgctccaagaacaccttccagaaggtgctgaacgtcaagagcaagctgaagtccatcgagacaatcatcatcctggacctgaacgacgacctcggcggctaccagtgcctgaacaacttcatcagccagaacagcgacagcaacctggacgtgaagaagttcaagccctacagcttcaaccgggacgaccaggtggccctgattatgtttagcagcggcaccaccggactgcccaaaggcgttatgctgacccacaagaatatcgtggcccggttctctatcgctaaggaccccaccttcggcaacgccatcaatcctacaagcgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggccttcctggctaagtctgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaagggcgacgccaagcctggcagcacaggcaagattgtgcctttccacgccgtgaaggtggtggaccctaccaccggaaagatcctgggacctaatgagcccggcgagctgtacttcaagggacccatgattatgaagggctactacaacaacgaggaagccaccaaggccattatcgacaacgacggctggctgcggagcggcgatattgcctactacgacaatgacggccacttctacatcgtggacagactgaagtccctcatcaagtacaagggctaccaggtcgcccctgccgagattgagggtatcctgctgcaacacccctatatcgtggatgccggcgtgacaggcatccctgatgaagctgctggcgaacttccagcagctggcgtggtggttcagaccggcaagtacctgaatgagcagatcgtgcaggactacgtggcctctcaggtgtccacagccaaatggctgagaggcggcgtgatcttcctggacgagatcccaaagggctctaccggcaagatcgacagaaaggtgctgcggcagatgctggaaaagcacaccaatggcctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 12005 - DNA, 1935 bp, Artificial Sequence
  Synthetic Polynucleotide
atggccttaccagtgaccgccttgctcctgccgctggccttgctgctccacgccgccaggccgatggccgacaagaacatcctgtacggccccgagcctttctaccctctggctgatggaacagccggcgagcagatgttcgatgccctgagcagatacgccgacatcagcggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacggcctccagttctttctgcctgtgatcgccagcctgtacctgggcattatcgctgcccctgtgtccgataagtacatcgagagagagctgatccacagcctgggcatcgtgaagccccggatcatcttctgctccaagaacaccttccagaaggtgctgaacgtcaagagcaagctgaagtccgtggaaaccatcatcatcctggacctgaacgaggacctcggcggctaccagtgcctgaacaacttcatctctcagaacagcgacagcaacctggacgtgaagaagttcaagccctacagcttcaaccgggacgaccaggtggccctggtcatgtttagctctggcacaaccggcgtgcccaagggcgttatgctgacccacaagaatatcgtggcccggttcagcctggctaaggaccctaccttcggcaacgccatcaatcccaccaccgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggcctttctggccaagtctgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaagggcgacgctagacctggcagcacaggcaagatcgtgcctttccacgccgtgaaggtggtggaccctacaaccggcaagatcctgggacctaatgagcccggcgagctgtactttaagggcgccatgattatgaagggctactacaacaacgaggaagccaccaaggccattatcgacaacgacggctggctgcggagcggcgatattgcctactacgacaatgacggccacttctacatcgtggacagactgaagtccctcatcaagtacaagggctaccaggtcgcccctgccgagattgagggtatcctgctgcaacacccctatatcgtggatgccggcgtgacaggcatccctgatgaagctgctggcgaacttccagcagcaggcgtggtggttcagaccggcaagtacctgaatgagcagatcgtgcaggacttcgtgtccagccaggtgtccacagccaaatggctgagaggcggcgtgaagttcctggacgagatcccaaagggctccaccggaaagatcgacagaaaggtgctgcggcagatgtttgagaagcacaccaacggcctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 12006 - DNA, 1935 bp, Artificial Sequence
  Synthetic Polynucleotide
atggccttaccagtgaccgccttgctcctgccgctggccttgctgctccacgccgccaggccgatggccgacaagaacatcctgtacggccccgagcctttctaccctctggctgatggaacagccggcgagcagatgttctacgccctgagcagatacgccgacatcagcggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacggcctccagttcttcctgcctatcattgccagcctgtacctgggcatcattgctgcccctgtgtccgataagtacatcgagagagagctgatccactctctgggcatcgtgaagccccggatcatcttctgctccaagaacaccttccagaaggtgctgaacgtcaagagcaagctgaaatacgtggaaaccatcatcatcctggacctgaacgaggacctcggcggctaccagtgcctgaacaacttcatctctcagaacagcgacatcaacctggacgtcaagaagttcaagccctacagcttcaaccgggacgaccaggtggccctggtcatgtttagctctggcacaaccggcgtgtccaagggcgtgatgctgacccacaagaatatcgtggcccggttcagcctggctaaggaccctaccttcggcaacgccatcaatcccaccaccgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggcctttctggctaagagcgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaacaacgatgtgcggcctggcagcacaggcaagatcgtgccttttcacgccgtgaaggtggtggaccctacaaccggcaagatcctgggacctaatgagcccggcgagctgtacttcaagggcgacatgattatgaagggctactacaacaacgaggaagccaccaaggccattatcaacaaggacggctggctgcggagcggcgacattgcctactatgacaacgacggccacttctacatcgtggaccggctgaagtccctgattaagtacaagggctaccaggtcgcccctgccgagattgagggtatcctgctgcaacacccctatatcgtggatgccggcgtgacaggcatccctgatgaagctgctggcgaacttccagcagctggcgtggtggttcagaccggcaagtacctgaatgagcagatcgtgcagaatttcgtgtccagccaggtgtccaccgccaagtggcttagaggcggcgtgaagttcctggacgagatccctaaaggctccaccggaaagatcgacagaaaggtgctgcgccagatgttcgagaagcacaccaatggcctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 12007 - DNA, 1929 bp, Artificial Sequence
  Synthetic Polynucleotide
atggccttaccagtgaccgccttgctcctgccgctggccttgctgctccacgccgccaggccgatgatgaagcgcgagaagaacgtgatctacggccccgaacctctgcaccctcttgaggatcttacagccggcgagatgctgttcagagccctgcggaaacacagccatctgcctcaggctctggtggatgtcgtgggagatgagagcctgtcctacaaagagttcttcgaggccaccgtgctgctggcccagtctctgcataattgcggctacaagatgaacgacgtggtgtccatctgcgccgagaacaacacccggttcttcatccctgtgatcgccgcctggtacatcggcatgattgtggcccctgtgaacgagagctacatccccgacgagctgtgcaaagtgatgggcatcagcaagccccagatcgtgttcaccaccaagaacatcctgaacaaggtgctggaagtgcagagccggaccaacttcatcaagcggatcatcatcctggacaccgtggaaaacatccacggctgcgagagcctgccaaacggcatctccagatacagcgacggcaatatcgccaacttcaagcccctgcacttcgaccccgtggaacaggtggcagccatcctgtgtagcagcggcacaacaggactgcccaaaggcgtgatgcagacccaccagaatatctgcgtgcggctgatccacgctctggaccctagagctggaacccagctgattcctggcgtgaccgtgctggtgtacctgcctttctttcacgccttcggcttcagcatcaccctgggctacttcatggtcggactgagagtgattatgtttcggcgcttcgaccaagaagccttcctgaaggccatccaggactacgaagtgcgctccgtgattaacgtgcccagcgtgatcctgttcctgagcaagagcccactggtggataagtacgacctgagcagcctgagagagctgtgttgcggagctgcccctctggctaaagaggtggcagaagttgccgccaagcggctgaatctgcctggcatcagatgtggctttggcctgaccgagagcaccagcgccaatatccacagcctgcgggacgagtttaagagcggctctctgggcagagtgacccctctgatggccgccaagatcgccgatagagagacaggcaaagccctgggacctaatcaagtgggcgagctgtgtatcaagggacctatggtgtccaagggctacgtgaacaacgtggaagccaccaaagaggccatcgacgacgacggctggctgcactctggcgatttcggctactacgacgaggacgagcacttctacgtggtggacagatacaaagagctgattaagtacaagggcagccaggtggccccagccgagctggaagaaatcctgctgaagaacccctgcatccgcgacgtggcagttgtgggcattcctgatctggaagccggcgaactgcctagcgcctttgtggttaagcagcccggcaaagagatcaccgccaaagaggtgtacgactacctggccgagagagtgtcccacaccaagtatctgagaggcggcgtcagattcgtggacagcatccccagaaacgtgaccggcaagatcacccggaaagagctgctgaaacagctgctggaaaaggctggcggactcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 12008 - DNA, 1929 bp, Artificial Sequence
  Synthetic Polynucleotide
atggccttaccagtgaccgccttgctcctgccgctggccttgctgctccacgccgccaggccgatggtaaagcgtgagaaaaatgtcatctatggccctgagcctctccatcctttggaggatttgactgccggcgaaatgctgtttcgtgctctccgcaagcactctcatttgcctcaagccttggtcgatgtggtcggcgatgaatctttgagctacaaggagttttttgaggcaaccgtcttgctggctcagtccctccacaattgtggctacaagatgaacgacgtcgttagtatctgtgctgaaaacaatacccgtttcttcattccagtcatcgccgcatggtatatcggtatgatcgtggctccagtcaacgagagctacattcccgacgaactgtgtaaagtcatgggtatctctaagccacagattgtcttcaccactaagaatattctgaacaaagtcctggaagtccaaagccgcaccaactttattaagcgtatcatcatcttggacactgtggagaatattcacggttgcgaatctttgcctaatttcatctctcgctattcagacggcaacatcgcaaactttaaaccactccacttcgaccctgtggaacaagttgcagccattctgtgtagcagcggtactactggactcccaaagggagtcatgcagacccatcaaaacatttgcgtgcgtctgatccatgctctcgatccacgctacggcactcagctgattcctggtgtcaccgtcttggtctacttgcctttcttccatgctttcggctttcatattactttgggttactttatggtcggtctccgcgtgattatgttccgccgttttgatcaggaggctttcttgaaagccatccaagattatgaagtccgcagtgtcatcaacgtgcctagcgtgatcctgtttttgtctaagagcccactcgtggacaagtacgacttgtcttcactgcgtgaattgtgttgcggtgccgctccactggctaaggaggtcgctgaagtggccgccaaacgcttgaatcttccagggattcgttgtggcttcggcctcaccgaatctaccagtgcgattatccagactctcggggatgagtttaagagcggctctttgggccgtgtcactccactcatggctgctaagatcgctgatcgcgaaactggtaaggctttgggcccgaaccaagtgggcgagctgtgtatcaaaggccctatggtgagcaagggttatgtcaataacgttgaagctaccaaggaggccatcgacgacgacggctggttgcattctggtgattttggatattacgacgaagatgagcatttttacgtcgtggatcgttacaaggagctgatcaaatacaagggtagccaggttgctccagctgagttggaggagattctgttgaaaaatccatgcattcgcgatgtcgctgtggtcggcattcctgatctggaggccggcgaactgccttctgctttcgttgtcaagcagcctggtacagaaattaccgccaaagaagtgtatgattacctggctgaacgtgtgagccatactaagtacttgcgtggcggcgtgcgttttgttgactccatccctcgtaacgtaacaggcaaaattacccgcaaggagctgttgaaacaattgttggtgaaggccggcggtctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 12009 - DNA, 1773 bp, Artificial Sequence
  Synthetic Polynucleotide
atggccttaccagtgaccgccttgctcctgccgctggccttgctgctccacgccgccaggccgatgatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtatgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccgggtctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 12010 - DNA, 1011 bp, Artificial Sequence
  Synthetic Polynucleotide
atggccttaccagtgaccgccttgctcctgccgctggccttgctgctccacgccgccaggccgatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 12011 - DNA, 1020 bp, Artificial Sequence
  Synthetic Polynucleotide
atggccttaccagtgaccgccttgctcctgccgctggccttgctgctccacgccgccaggccgatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 12012 - skipped

SEQ ID NO: 12013 - DNA, 837 bp, Artificial Sequence
  Synthetic Polynucleotide
atgaactccttctccacaagcgccttcggtccagttgccttctccctgggcctgctcctggtgttgcctgctgccttccctgccccagtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12014 - DNA, 810 bp, Artificial Sequence
  Synthetic Polynucleotide
atggccttaccagtgaccgccttgctcctgccgctggccttgctgctccacgccgccaggccgatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12015 - DNA, 816 bp, Artificial Sequence
  Synthetic Polynucleotide
atggccttaccagtgaccgccttgctcctgccgctggccttgctgctccacgccgccaggccgatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12016 - DNA, 747 bp, Artificial Sequence
  Synthetic Polynucleotide
atggccttaccagtgaccgccttgctcctgccgctggccttgctgctccacgccgccaggccgatggaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12017 - DNA, 762 bp, Artificial Sequence
  Synthetic Polynucleotide
atggccttaccagtgaccgccttgctcctgccgctggccttgctgctccacgccgccaggccgatgaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12018 - DNA, 921 bp, Artificial Sequence
  Synthetic Polynucleotide
atggccttaccagtgaccgccttgctcctgccgctggccttgctgctccacgccgccaggccgatgctgcctgccagccccaccgacagatccatcgtgctggacaacggctacgtgtgcagctgggagggcatccccgacgacctgagagactgccccaagaccgaggacatgagcaagcagcatggcgctgccctgaagctgccccccgatgtgctggacgagatggaatgcaacgccaagaaaagcggctgcgtgcggggctgcctccagtgtctggccctgattaagtgcaccgccaagatgcggaagtacatccccggcagatgccacagctacgagggcgacaaggacattgcccagggcggcatcggcaaagagctgaccatcgacatccccgagatccccggcttcctggacctggcccctatggatcagttcgtggcccaggtggacctgtgcgtggactgctccagcagatgcctgaagggcctggctaacgtgcagtgctcctgcaagctgtataagtggctgcccaccagatgcaccggcttccaggccaagatcaagaaagaggccgacaccgtgatcggactggaagatgccctggccctgggcttcgacaccatccaggcttgtgtggccgctggcaagtgcaaggacaccgtgggcagatacagcctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12019 - DNA, 810 bp, Artificial Sequence
  Synthetic Polynucleotide
atggccttaccagtgaccgccttgctcctgccgctggccttgctgctccacgccgccaggccgatggccgcctctgaagaggccgatgacgatcacgtgtccctcgtgaagaactactggcggatcggcgtgggcaacgagcgggatgtgtctctggatagaggcggccctcccaagctgagcaaagaactgctggccgagatgcacgccattgccagcaatgccggctgctccagagtgtgcctgatcggcctgagcaagatcaagtgcacccccaagatgaagaccttcctgcccggcagatgcaacaccttcgcccctaaacctgccaccggcgacggaccttttgccgccgctgctgccatccctggcttcagcgatctgaccgctatggaacagtacaaggcccaggtggcccagtgcgactgctccaacagatgcctcgtgggcctggctaacatcaagtgttctgccgccctgaaggccgccctgcctcagagatgtaccacctttgccaccaacatccagaaagagggcgaggtggacagcatcaagggctacggcagaaagctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12020 - DNA, 888 bp, Artificial Sequence
  Synthetic Polynucleotide
atggccttaccagtgaccgccttgctcctgccgctggccttgctgctccacgccgccaggccgatgcagcccaccgagaacaagcaggaaagccagatcgaggacatcgacagaagcaccagcctgggcctgatgtgctacgagcagtgtacaggccagagcggcctggatctgaagtgctacaaagagtgcgccgacttcaccggcgaccggaacagaggcagaaagctgcccggcaagaaactgcccctggaagtgctgaagatcatggaagccaacgccagaagggccggctgcaccagaggctgcctgatctgcctgagcaagatcaagtgcaccgccaagatgaagcagtacatccccggcagatgccacacctacgagggcgacaagtctatcggccagggcggcatcggaggccccatcgtggatatccctgagatcatcggcttccagaacatggaacctatggaacagtttatcgcccaggtggacctgtgcgccgattgcacaaccggctgtctgaagggcctggctaacgtgcggtgcaacgacctgctgaagaagtggctgcccgacagatgcgccggcttcgccaacaagatccagagcgaggtggacaacatcaagggactggccggcgacagactcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12021 - DNA, 813 bp, Artificial Sequence
  Synthetic Polynucleotide
atggccttaccagtgaccgccttgctcctgccgctggccttgctgctccacgccgccaggccgatgaagagcatagacagctacgaaaatattgatatagtggctgttgcgggcaacttcgctgctgttgaccaggacgctaaccgcggaggaaacctgccgggtaagaaaatgccaatagaggttcttaaagaaatggaagctaacgccaagcgagcagggtgtgttcggggctgtttgatatgcttgtcccacatcaaatgcacagctaaaatgaaaaaattcataccaggtcggtgtcatagctatcatggagatgcagatacgaagcaaggggcacttgaagaagtggttgacatgcccgagataccgggatttgtggacatggagcccatggaacagtttatagcccaggtggataaatgcgaggactgtaccactggttgtttgaaaggtctcgccaacgtccactgcagcgatctcctcaagaaatggctgccgcaaagatgctcacagtttgcggataagatccaatccgaggtggacacaataaagggcctggcaggggaccggctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12022 - DNA, 882 bp, Artificial Sequence
  Synthetic Polynucleotide
atggccttaccagtgaccgccttgctcctgccgctggccttgctgctccacgccgccaggccgatgaacccgacggagaacaaggacgatattgatattgtgggagtggaaggcaaattcgggactacggatcttgaaactgatctctttacgattgttgaggacatgaacgtaatctcaagggatacgaacctggcaaatagtgacgcagaccgaggcaaaatgccgggaaaaaaacttccgttggaagtactgatcgagatggaagcgaatgcacgcaaggcagggtgtacacggggatgcttgatctgtctgagtaagattaaatgcaccgctaaaatgaaagtttatatacccggtcggtgccacgattatgggggcgataagaaaaccggtcaggcagggatcgtcggagcaatcgtggatattcctgaaatttcaggattcaaagaacttggaccaatggagcaatttatagcacaagtggacctctgcgctgactgcacgacgggatgtctgaaaggtcttgcaaatgtaaagtgttcagcactccttaagaaatggcttcccgaccgatgtgcctcttttgctgacaagattcagtctgaagttgataacataaagggtcttgcgggtgatcggctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12023 - DNA, 813 bp, Artificial Sequence
  Synthetic Polynucleotide
atggccttaccagtgaccgccttgctcctgccgctggccttgctgctccacgccgccaggccgatgaagcctaccgaaaataatgatgatattgatatagttgggatcgcaagtacatttatcacgacaaacaccgacgcggaccggggcaagatgccgggaaagaaacttcccttggcagtcctcaaggaaatggaggcgaacgctgcaaaggcagggtgttccagaggttgtctgatctgcttgtctaaaatcaagtgtacagctaagatgaagcagtttattccggggcgctgtcacgactacggtggtgataaaaaaacgggccaggcggcgctggtcggagcaatattcgacatccctgaaatcttcggatttctcgatatggaacctatcgagcagttcatagcacaagtagatttgtgtgctggctgcacaacaggctgcttgaaaggactcgcaaatattaagtgttctgaactcttgaagaagtggcttccgaaaagatgtacctccttcgcgtataaaatgcaaaaggaaatgcacaatataaaaggcatggcaggagatcggctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12024 - DNA, 813 bp, Artificial Sequence
  Synthetic Polynucleotide
atggccttaccagtgaccgccttgctcctgccgctggccttgctgctccacgccgccaggccgatgaaagcgaccgaaaacaatgacgacatagacatagttggaatcgcgtcaaccttcataacgacaaacacggacgccgaccgaggcaaaatgccggggaaaagattgccactggcggtgttgaaagagatggaagcgaacgcagtcaaagcgggatgtagcaggggctgccttatatgtctgagtaagattaaatgcaccgcgaagatgaagcaatacatccccggcaggtgccacgattacggaggagacaagaagaccgggcaggcggctatagagggcgcgatagatgatattcctgaaatctctggctttaaggagatggcgcctatggagcaattcattgcgcaggttgacttgtgcgcagactgcacgacaggatgcctcaagggcttggcaaatgtaaaatgttccgaacttctgaaaaaatggctgcccaagaggtgtacctccttcgccacgaagatgcaaaaggagatccataacatcaaaggcatggggggggaccgcctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12025 - DNA, 891 bp, Artificial Sequence
  Synthetic Polynucleotide
atggccttaccagtgaccgccttgctcctgccgctggccttgctgctccacgccgccaggccgatgaaccctacggagacccaggacggagtggacattctcggcgtggaagggaaattcgggacagaaaccaacttggagactgatctgtttaccatttgggagataaatggaataattaaatctgatcgcgacacaaatagggcaaatgcagacgctgatcgaggaaaaatgcccggcaagaaacttcctttggcggtgctcatagagatggaggcaaacgcattcaaagcgggttgcactcgcggttgtctcatttgtttgtccaaaatcaaatgcacggctaagatgaaagagtatatcccaggacggtgccatgattacggtggggataaaaaaacgggacaagcaggtatagtaggtgctatcgtggacattccagaaatctcaggatttaaagagcttggccccatggagcaattcatagcgcaagtagacctttgcgctgattgcactactggctgtcttaagggactggcgaatgttaagtgcagcgccctgttgaagaagtggctgccagaccgatgcgcatcattcgcggataagatacagtccgaagtccataatataaaaggtctcgcaggtgatcgcctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12026 - DNA, 825 bp, Artificial Sequence
  Synthetic Polynucleotide
atggccttaccagtgaccgccttgctcctgccgctggccttgctgctccacgccgccaggccgatggccacaatcaatgaaaatttcgaagacatcgaccttgtcgcgattggaggctcatttgctacagatgtggacgccaacaggggtggtcatggtggacatccgggcaaaaagatgcctaaagaggtcttgttggaaatggaagcgaacgcaaaacgagccggatgtcataggggttgtttgatttgtctttctcacatcaaatgtacgcagaagatgaagaaattcataccgggacggtgtcactcctatgctggtgacaaggatagcgctcagggcggcataacagaggaggagactgttgacatgcccgagatcgctgggttcaaggatcttgaacctatggagcagtttattgcacaggtagacttgtgcgttgactgcacaactggttgtttgaaagggctggccaacgtccactgttctgacttgctcaaaaagtggctgccttcccggtgcaagacttttgcctcaaaaattcagagtcaggttgacaccatcaaggggttggctggtgacaggctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12027 - DNA, 882 bp, Artificial Sequence
  Synthetic Polynucleotide
atggccttaccagtgaccgccttgctcctgccgctggccttgctgctccacgccgccaggccgatgaatcctacagagaacaatgatcatatcaatattgtcgggatcgagggtaaattcggaatcacagacttggagacggatctcttcactatctgggagacaaatcgcatgatttctaccgataacgaacaggcaaatacagacagtaatagagggaagatgccaggtaagaaactgccattggcagttcttatagagatggaagccaacgctttcaaggcgggttgtacaagaggctgtctcatttgcttgtctaaaatcaagtgtactgctaagatgaagaaatacataccgggaagatgccatgactacggaggtgataagaagactgggcaggcaggaatcgtgggcgcgattgtcgacatacccgacatatccgggttcaaggaaatgggaccgatggagcaattcatcgcccaagtggatcgatgcaccgactgcacaacgggatgtttgaagggtcttgcaaatgttaagtgctccgagctgttgaagaagtggttgccggaccgctgcgcgagtttcgccgataaaattcaaagtgaggtgcataatattaaaggtctggcgggagatcgcctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12028 - DNA, 801 bp, Artificial Sequence
  Synthetic Polynucleotide
atggccttaccagtgaccgccttgctcctgccgctggccttgctgctccacgccgccaggccgatgcaacccactgagaataaaaaggaatcctataccgaagacacagacgtaaacggggaccatgatcgaggcaggaagcttccggggaagaaacttccactggaagttctgaaaatcatggaagctaacgcaaggagagcaggttgcacgcgaggctgtttgatatgtcttagcaagataaaatgtactgcaaaaatgaagcaatacataccgggaagatgccatacttatgagggggacaaaagcatagggcaggcaggcataggaggcccaatcattgatataccggaaattatagggtttaagaacatggaaccaatggaacagttcatcgcacaggtggatctctgtgcggactgcactactggatgcctcaaaggtctcgcaaatgtaagatgcaacgatcttttgaaaaaatggttgccagatcgatgcgcggggttcgcactcaagatacaaggtgaagtggaaaacataaaggggatggccggggatcgactcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12029 - DNA, 921 bp, Artificial Sequence
  Synthetic Polynucleotide
atggccttaccagtgaccgccttgctcctgccgctggccttgctgctccacgccgccaggccgatgcttccagcgtcacccaccgataggtcaatagtccttgacaacggctatgtgtgttcctgggagggtatcccagacgacctgcgggactgtccgaagacagaggatatgtctaagcagcacggagctgctctcaaactgccgccagatgtgttggatgagatggaatgtaatgctaaaaagagtggatgcgtgcgaggatgtcttcagtgtctggcactcataaaatgtactgcaaaaatgagaaagtatatccccggacgctgtcatagctacgagggtgacaaggacattgctcagggggggatcggaaaggaactgacaattgacatccctgagattcctggcttcttggatcttgcaccaatggaccagttcgtggcgcaggtcgacctctgcgtggactgcagcagtcggtgcctgaagggcttggctaatgtccaatgcagttgtaagctctacaaatggttgccaacccggtgtaccggcttccaagcgaaaataaagaaagaagctgacacggtaattgggctggaagatgcgctcgcactcggattcgacaccatccaggcatgcgtagcggccggtaaatgcaaggatacggttggccggtactctctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12030 - DNA, 837 bp, Artificial Sequence
  Synthetic Polynucleotide
atggccttaccagtgaccgccttgctcctgccgctggccttgctgctccacgccgccaggccgatgtgggcggcctccgaggaggccgatgacgacctcgtatctttggtcaaaaactactggggcgtaggcgtaagcaatgaacgcgatgtatctctcgacagggggggccatggcaagctgccgaaaaagcttagcgttgagattctcgctgaaatggaagcaaacgcccagaagagtaattgctctcgggggtgtctgatagggctttctaaaattaaatgcacgcccaaaatgaaaaaattcctccctggcaggtgccacgaatactctggtgatcccaaaactggacagggtccgcttactgcggctgcggttataccagggtatagtgatcttacagctatggagcagttcaagctccaagtagacaagtgtgactgttcaactcaatgtcttaagggtcttgcaaatgtcaagtgctcagcggccctcaaagcggtgttgccaacaagatgctcacaattcgcaactcagatccaagctgaagtaggcaccataaaagggaaggggaagaaaccgactccaccgataggtctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12031 - DNA, 882 bp, Artificial Sequence
  Synthetic Polynucleotide
atggccttaccagtgaccgccttgctcctgccgctggccttgctgctccacgccgccaggccgatgaaacccactgaaatcaatgaagacctcaatatagctgctgtggcctccaactttgccaccacagatcttgagactgacctgttcaccaactgggagaccatgaatgtgattagcactgacacagagcaggtgaacacagatgctgacaggggcaagctgcctggcaaaaaactccccccagatgtcctgagggagctggaggccaatgccagaagggctggttgcacaagaggctgcctcatttgcctctcccacattaagtgcacccctaagatgaagaaatttatccctggcaggtgccacacttatgaaggtgaaaaggagtctgctcagggagggattggagaggcaattgttgatatcccagagattcctggcttcaaggataaggagccactggaccagtttattgctcaagtggacctctgtgctgattgcaccactggctgtctgaagggccttgccaatgtccagtgctctgacctcctgaagaagtggcttccccagaggtgtaccacttttgccagcaagattcagggtagggtggacaaaatcaagggtctggctggggacagactcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12032 - DNA, 1236 bp, Artificial Sequence
  Synthetic Polynucleotide
atggccttaccagtgaccgccttgctcctgccgctggccttgctgctccacgccgccaggccgatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12033 - DNA, 1953 bp, Artificial Sequence
  Synthetic Polynucleotide
atggccttaccagtgaccgccttgctcctgccgctggccttgctgctccacgccgccaggccgatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12034 - DNA, 1935 bp, Artificial Sequence
  Synthetic Polynucleotide
atggccttaccagtgaccgccttgctcctgccgctggccttgctgctccacgccgccaggccgatggccgacaagaacatcctgtacggccccgagcctttctaccctctggaagatggaacagccggcgagcagatgttcgacgccctgagcagatatgccgccattcctggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacagcctccagttcttcctgcctgtgatcgccagcctgtacctgggcattattgtggcccctgtgaacgacaagtacatcgagagagagctgatccacagcctgggcatcgtgaagccccggatcgtgttctgctccaagaacaccttccagaaggtgctgaacgtcaagagcaagctgaagtccatcgagacaatcatcatcctggacctgaacgaggacctcggcggctaccagtgcctgaacaacttcatcagccagaacagcgacagcaacctggacgtgaagaagttcaagccctacagcttcaaccgggacgaccaggtggcctccatcatgtttagcagcggcaccaccggactgcccaaaggcgttatgctgacccacaagaatatcgtggcccggttctctatcgctaaggaccccaccttcggcaacgccatcaatcctacaagcgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggccttcctggctaagtctgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaagggcgacgccaagcctggcagcacaggcaaaattgtgcctctgcacgccgtgaaggtggtggaccctaccacaggcaagatcctgggacctaatgagcccggcgagctgtacttcaagggacccatgattatgaagggctactacaacaacgaggaagccaccaaggccattatcgacaacgacggctggctgcggagcggcgatattgcctactacgacaatgacggccacttctacatcgtggacagactgaagtccctcatcaagtacaagggctatcaggtggccccagccgagatcgagggtatcctgctgcaacacccctatatcgtggatgccggcgtgacaggcatccctgatgaagctgctggcgaacttccagcagctggcgtggtggttcagaccggcaagtacctgaatgagcagatcgtgcaggactacgtggcctctcaggtgtccacagccaaatggctgagaggcggcgtgaagttcctggacgagatcccaaagggctctaccggcaagatcgacagaaaggtgctgcggcagatgctggaaaagcacaccaatggcctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12035 - DNA, 1935 bp, Artificial Sequence
  Synthetic Polynucleotide
atggccttaccagtgaccgccttgctcctgccgctggccttgctgctccacgccgccaggccgatggccgacaagaacatcctgtacggccccgagcctttctaccctctggaagatggaacagccggcgagcagatgttcgacgccctgagcagatacgccgacattcctggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacagcctccagttcttcctgcctgtgatcgccagcctgtacctgggcattattgtggcccctgtgaacgacaagtacatcgagagagagctgatccacagcctgggcatcgtgaagccccggatcgtgttctgctccaagaacaccttccagaaggtgctgaacgtcaagagcaagctgaagtccatcgagacaatcatcatcctggacctgaacgacgacctcggcggctaccagtgcctgaacaacttcatcagccagaacagcgacagcaacctggacgtgaagaagttcaagccctacagcttcaaccgggacgaccaggtggccctgattatgtttagcagcggcaccaccggactgcccaaaggcgttatgctgacccacaagaatatcgtggcccggttctctatcgctaaggaccccaccttcggcaacgccatcaatcctacaagcgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggccttcctggctaagtctgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaagggcgacgccaagcctggcagcacaggcaagattgtgcctttccacgccgtgaaggtggtggaccctaccaccggaaagatcctgggacctaatgagcccggcgagctgtacttcaagggacccatgattatgaagggctactacaacaacgaggaagccaccaaggccattatcgacaacgacggctggctgcggagcggcgatattgcctactacgacaatgacggccacttctacatcgtggacagactgaagtccctcatcaagtacaagggctaccaggtcgcccctgccgagattgagggtatcctgctgcaacacccctatatcgtggatgccggcgtgacaggcatccctgatgaagctgctggcgaacttccagcagctggcgtggtggttcagaccggcaagtacctgaatgagcagatcgtgcaggactacgtggcctctcaggtgtccacagccaaatggctgagaggcggcgtgatcttcctggacgagatcccaaagggctctaccggcaagatcgacagaaaggtgctgcggcagatgctggaaaagcacaccaatggcctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12036 - DNA, 1935 bp, Artificial Sequence
  Synthetic Polynucleotide
atggccttaccagtgaccgccttgctcctgccgctggccttgctgctccacgccgccaggccgatggccgacaagaacatcctgtacggccccgagcctttctaccctctggctgatggaacagccggcgagcagatgttcgatgccctgagcagatacgccgacatcagcggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacggcctccagttctttctgcctgtgatcgccagcctgtacctgggcattatcgctgcccctgtgtccgataagtacatcgagagagagctgatccacagcctgggcatcgtgaagccccggatcatcttctgctccaagaacaccttccagaaggtgctgaacgtcaagagcaagctgaagtccgtggaaaccatcatcatcctggacctgaacgaggacctcggcggctaccagtgcctgaacaacttcatctctcagaacagcgacagcaacctggacgtgaagaagttcaagccctacagcttcaaccgggacgaccaggtggccctggtcatgtttagctctggcacaaccggcgtgcccaagggcgttatgctgacccacaagaatatcgtggcccggttcagcctggctaaggaccctaccttcggcaacgccatcaatcccaccaccgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggcctttctggccaagtctgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaagggcgacgctagacctggcagcacaggcaagatcgtgcctttccacgccgtgaaggtggtggaccctacaaccggcaagatcctgggacctaatgagcccggcgagctgtactttaagggcgccatgattatgaagggctactacaacaacgaggaagccaccaaggccattatcgacaacgacggctggctgcggagcggcgatattgcctactacgacaatgacggccacttctacatcgtggacagactgaagtccctcatcaagtacaagggctaccaggtcgcccctgccgagattgagggtatcctgctgcaacacccctatatcgtggatgccggcgtgacaggcatccctgatgaagctgctggcgaacttccagcagcaggcgtggtggttcagaccggcaagtacctgaatgagcagatcgtgcaggacttcgtgtccagccaggtgtccacagccaaatggctgagaggcggcgtgaagttcctggacgagatcccaaagggctccaccggaaagatcgacagaaaggtgctgcggcagatgtttgagaagcacaccaacggcctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12037 - DNA, 1935 bp, Artificial Sequence
  Synthetic Polynucleotide
atggccttaccagtgaccgccttgctcctgccgctggccttgctgctccacgccgccaggccgatggccgacaagaacatcctgtacggccccgagcctttctaccctctggctgatggaacagccggcgagcagatgttctacgccctgagcagatacgccgacatcagcggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacggcctccagttcttcctgcctatcattgccagcctgtacctgggcatcattgctgcccctgtgtccgataagtacatcgagagagagctgatccactctctgggcatcgtgaagccccggatcatcttctgctccaagaacaccttccagaaggtgctgaacgtcaagagcaagctgaaatacgtggaaaccatcatcatcctggacctgaacgaggacctcggcggctaccagtgcctgaacaacttcatctctcagaacagcgacatcaacctggacgtcaagaagttcaagccctacagcttcaaccgggacgaccaggtggccctggtcatgtttagctctggcacaaccggcgtgtccaagggcgtgatgctgacccacaagaatatcgtggcccggttcagcctggctaaggaccctaccttcggcaacgccatcaatcccaccaccgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggcctttctggctaagagcgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaacaacgatgtgcggcctggcagcacaggcaagatcgtgccttttcacgccgtgaaggtggtggaccctacaaccggcaagatcctgggacctaatgagcccggcgagctgtacttcaagggcgacatgattatgaagggctactacaacaacgaggaagccaccaaggccattatcaacaaggacggctggctgcggagcggcgacattgcctactatgacaacgacggccacttctacatcgtggaccggctgaagtccctgattaagtacaagggctaccaggtcgcccctgccgagattgagggtatcctgctgcaacacccctatatcgtggatgccggcgtgacaggcatccctgatgaagctgctggcgaacttccagcagctggcgtggtggttcagaccggcaagtacctgaatgagcagatcgtgcagaatttcgtgtccagccaggtgtccaccgccaagtggcttagaggcggcgtgaagttcctggacgagatccctaaaggctccaccggaaagatcgacagaaaggtgctgcgccagatgttcgagaagcacaccaatggcctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12038 - DNA, 1929 bp, Artificial Sequence
  Synthetic Polynucleotide
atggccttaccagtgaccgccttgctcctgccgctggccttgctgctccacgccgccaggccgatgatgaagcgcgagaagaacgtgatctacggccccgaacctctgcaccctcttgaggatcttacagccggcgagatgctgttcagagccctgcggaaacacagccatctgcctcaggctctggtggatgtcgtgggagatgagagcctgtcctacaaagagttcttcgaggccaccgtgctgctggcccagtctctgcataattgcggctacaagatgaacgacgtggtgtccatctgcgccgagaacaacacccggttcttcatccctgtgatcgccgcctggtacatcggcatgattgtggcccctgtgaacgagagctacatccccgacgagctgtgcaaagtgatgggcatcagcaagccccagatcgtgttcaccaccaagaacatcctgaacaaggtgctggaagtgcagagccggaccaacttcatcaagcggatcatcatcctggacaccgtggaaaacatccacggctgcgagagcctgccaaacggcatctccagatacagcgacggcaatatcgccaacttcaagcccctgcacttcgaccccgtggaacaggtggcagccatcctgtgtagcagcggcacaacaggactgcccaaaggcgtgatgcagacccaccagaatatctgcgtgcggctgatccacgctctggaccctagagctggaacccagctgattcctggcgtgaccgtgctggtgtacctgcctttctttcacgccttcggcttcagcatcaccctgggctacttcatggtcggactgagagtgattatgtttcggcgcttcgaccaagaagccttcctgaaggccatccaggactacgaagtgcgctccgtgattaacgtgcccagcgtgatcctgttcctgagcaagagcccactggtggataagtacgacctgagcagcctgagagagctgtgttgcggagctgcccctctggctaaagaggtggcagaagttgccgccaagcggctgaatctgcctggcatcagatgtggctttggcctgaccgagagcaccagcgccaatatccacagcctgcgggacgagtttaagagcggctctctgggcagagtgacccctctgatggccgccaagatcgccgatagagagacaggcaaagccctgggacctaatcaagtgggcgagctgtgtatcaagggacctatggtgtccaagggctacgtgaacaacgtggaagccaccaaagaggccatcgacgacgacggctggctgcactctggcgatttcggctactacgacgaggacgagcacttctacgtggtggacagatacaaagagctgattaagtacaagggcagccaggtggccccagccgagctggaagaaatcctgctgaagaacccctgcatccgcgacgtggcagttgtgggcattcctgatctggaagccggcgaactgcctagcgcctttgtggttaagcagcccggcaaagagatcaccgccaaagaggtgtacgactacctggccgagagagtgtcccacaccaagtatctgagaggcggcgtcagattcgtggacagcatccccagaaacgtgaccggcaagatcacccggaaagagctgctgaaacagctgctggaaaaggctggcggactcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12039 - DNA, 1929 bp, Artificial Sequence
  Synthetic Polynucleotide
atggccttaccagtgaccgccttgctcctgccgctggccttgctgctccacgccgccaggccgatggtaaagcgtgagaaaaatgtcatctatggccctgagcctctccatcctttggaggatttgactgccggcgaaatgctgtttcgtgctctccgcaagcactctcatttgcctcaagccttggtcgatgtggtcggcgatgaatctttgagctacaaggagttttttgaggcaaccgtcttgctggctcagtccctccacaattgtggctacaagatgaacgacgtcgttagtatctgtgctgaaaacaatacccgtttcttcattccagtcatcgccgcatggtatatcggtatgatcgtggctccagtcaacgagagctacattcccgacgaactgtgtaaagtcatgggtatctctaagccacagattgtcttcaccactaagaatattctgaacaaagtcctggaagtccaaagccgcaccaactttattaagcgtatcatcatcttggacactgtggagaatattcacggttgcgaatctttgcctaatttcatctctcgctattcagacggcaacatcgcaaactttaaaccactccacttcgaccctgtggaacaagttgcagccattctgtgtagcagcggtactactggactcccaaagggagtcatgcagacccatcaaaacatttgcgtgcgtctgatccatgctctcgatccacgctacggcactcagctgattcctggtgtcaccgtcttggtctacttgcctttcttccatgctttcggctttcatattactttgggttactttatggtcggtctccgcgtgattatgttccgccgttttgatcaggaggctttcttgaaagccatccaagattatgaagtccgcagtgtcatcaacgtgcctagcgtgatcctgtttttgtctaagagcccactcgtggacaagtacgacttgtcttcactgcgtgaattgtgttgcggtgccgctccactggctaaggaggtcgctgaagtggccgccaaacgcttgaatcttccagggattcgttgtggcttcggcctcaccgaatctaccagtgcgattatccagactctcggggatgagtttaagagcggctctttgggccgtgtcactccactcatggctgctaagatcgctgatcgcgaaactggtaaggctttgggcccgaaccaagtgggcgagctgtgtatcaaaggccctatggtgagcaagggttatgtcaataacgttgaagctaccaaggaggccatcgacgacgacggctggttgcattctggtgattttggatattacgacgaagatgagcatttttacgtcgtggatcgttacaaggagctgatcaaatacaagggtagccaggttgctccagctgagttggaggagattctgttgaaaaatccatgcattcgcgatgtcgctgtggtcggcattcctgatctggaggccggcgaactgccttctgctttcgttgtcaagcagcctggtacagaaattaccgccaaagaagtgtatgattacctggctgaacgtgtgagccatactaagtacttgcgtggcggcgtgcgttttgttgactccatccctcgtaacgtaacaggcaaaattacccgcaaggagctgttgaaacaattgttggtgaaggccggcggtctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12040 - DNA, 1773 bp, Artificial Sequence
  Synthetic Polynucleotide
atggccttaccagtgaccgccttgctcctgccgctggccttgctgctccacgccgccaggccgatgatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtatgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccgggtctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12041 - DNA, 1011 bp, Artificial Sequence
  Synthetic Polynucleotide
atggccttaccagtgaccgccttgctcctgccgctggccttgctgctccacgccgccaggccgatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 12042 - DNA, 810 bp, Artificial Sequence; identical to SEQ ID NO: 12014
  Synthetic Polynucleotide

SEQ ID NO: 12043 - skipped

SEQ ID NO: 12044 - DNA, 2136 bp, Artificial Sequence
  Synthetic Polynucleotide
atgaagtgccttttgtacttagcctttttattcattggggtgaattgcaagttcaccatagtttttccacacaaccaaaaaggaaactggaaaaatgttccttctaattaccattattgcccgtcaagctcagatttaaattggcataatgacttaataggcacagccttacaagtcaaaatgcccaagagtcacaaggctattcaagcagacggttggatgtgtcatgcttccaaatgggtcactacttgtgatttccgctggtatggaccgaagtatataacacattccatccgatccttcactccatctgtagaacaatgcaaggaaagcattgaacaaacgaaacaaggaacttggctgaatccaggcttccctcctcaaagttgtggatatgcaactgtgacggatgccgaagcagtgattgtccaggtgactcctcaccatgtgctggttgatgaatacacaggagaatgggttgattcacagttcatcaacggaaaatgcagcaattacatatgccccactgtccataactctacaacctggcattctgactataaggtcaaagggctatgtgattctaacctcatttccatggacatcaccttcttctcagaggacggagagctatcatccctgggaaaggagggcacagggttcagaagtaactactttgcttatgaaactggaggcaaggcctgcaaaatgcaatactgcaagcattggggagtcagactcccatcaggtgtctggttcgagatggctgataaggatctctttgctgcagccagattccctgaatgcccagaagggtcaagtatctctgctccatctcagacctcagtggatgtaagtctaattcaggacgttgagaggatcttggattattccctctgccaagaaacctggagcaaaatcagagcgggtcttccaatctctccagtggatctcagctatcttgctcctaaaaacccaggaaccggtcctgctttcaccataatcaatggtaccctaaaatactttgagaccagatacatcagagtcgatattgctgctccaatcctctcaagaatggtcggaatgatcagtggaactaccacagaaagggaactgtgggatgactgggcaccatatgaagacgtggaaattggacccaatggagttctgaggaccagttcaggatataagtttcctttatacatgattggacatggtatgttggactccgatcttcatcttagctcaaaggctcaggtgttcgaacatcctcacattcaagacgctgcttcgcaacttcctgatgatgagagtttattttttggtgatactgggctatccaaaaatccaatcgagcttgtagaaggttggttcagtagttggaaaagctctattgcctcttttttctttatcatagggttaatcattggactattcttggttctccgagttggtatccatctttgcattaaattaaagcacaccaagaaaagacagatttatacagacatagagatgaaccgacttggaaagagggccaagcgatctggatctggagcaacaaacttctcactactcaaacaagcaggtgacgtggaggagaatcccgggcctactagtatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgtga

SEQ ID NO: 12045 - DNA, 2442 bp, Artificial Sequence
  Synthetic Polynucleotide
atgaagtgccttttgtacttagcctttttattcattggggtgaattgcaagttcaccatagtttttccacacaaccaaaaaggaaactggaaaaatgttccttctaattaccattattgcccgtcaagctcagatttaaattggcataatgacttaataggcacagccttacaagtcaaaatgcccaagagtcacaaggctattcaagcagacggttggatgtgtcatgcttccaaatgggtcactacttgtgatttccgctggtatggaccgaagtatataacacattccatccgatccttcactccatctgtagaacaatgcaaggaaagcattgaacaaacgaaacaaggaacttggctgaatccaggcttccctcctcaaagttgtggatatgcaactgtgacggatgccgaagcagtgattgtccaggtgactcctcaccatgtgctggttgatgaatacacaggagaatgggttgattcacagttcatcaacggaaaatgcagcaattacatatgccccactgtccataactctacaacctggcattctgactataaggtcaaagggctatgtgattctaacctcatttccatggacatcaccttcttctcagaggacggagagctatcatccctgggaaaggagggcacagggttcagaagtaactactttgcttatgaaactggaggcaaggcctgcaaaatgcaatactgcaagcattggggagtcagactcccatcaggtgtctggttcgagatggctgataaggatctctttgctgcagccagattccctgaatgcccagaagggtcaagtatctctgctccatctcagacctcagtggatgtaagtctaattcaggacgttgagaggatcttggattattccctctgccaagaaacctggagcaaaatcagagcgggtcttccaatctctccagtggatctcagctatcttgctcctaaaaacccaggaaccggtcctgctttcaccataatcaatggtaccctaaaatactttgagaccagatacatcagagtcgatattgctgctccaatcctctcaagaatggtcggaatgatcagtggaactaccacagaaagggaactgtgggatgactgggcaccatatgaagacgtggaaattggacccaatggagttctgaggaccagttcaggatataagtttcctttatacatgattggacatggtatgttggactccgatcttcatcttagctcaaaggctcaggtgttcgaacatcctcacattcaagacgctgcttcgcaacttcctgatgatgagagtttattttttggtgatactgggctatccaaaaatccaatcgagcttgtagaaggttggttcagtagttggaaaagctctattgcctcttttttctttatcatagggttaatcattggactattcttggttctccgagttggtatccatctttgcattaaattaaagcacaccaagaaaagacagatttatacagacatagagatgaaccgacttggaaagagggccaagcgatctggatctggagcaacaaacttctcactactcaaacaagcaggtgacgtggaggagaatcccgggcctactagtatgaactccttctccacaagcgccttcggtccagttgccttctccctgggcctgctcctggtgttgcctgctgccttccctgccccagtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagctga

SEQ ID NO: 12046 - DNA, 2460 bp, Artificial Sequence
  Synthetic Polynucleotide
atgaagtgccttttgtacttagcctttttattcattggggtgaattgcaagttcaccatagtttttccacacaaccaaaaaggaaactggaaaaatgttccttctaattaccattattgcccgtcaagctcagatttaaattggcataatgacttaataggcacagccttacaagtcaaaatgcccaagagtcacaaggctattcaagcagacggttggatgtgtcatgcttccaaatgggtcactacttgtgatttccgctggtatggaccgaagtatataacacattccatccgatccttcactccatctgtagaacaatgcaaggaaagcattgaacaaacgaaacaaggaacttggctgaatccaggcttccctcctcaaagttgtggatatgcaactgtgacggatgccgaagcagtgattgtccaggtgactcctcaccatgtgctggttgatgaatacacaggagaatgggttgattcacagttcatcaacggaaaatgcagcaattacatatgccccactgtccataactctacaacctggcattctgactataaggtcaaagggctatgtgattctaacctcatttccatggacatcaccttcttctcagaggacggagagctatcatccctgggaaaggagggcacagggttcagaagtaactactttgcttatgaaactggaggcaaggcctgcaaaatgcaatactgcaagcattggggagtcagactcccatcaggtgtctggttcgagatggctgataaggatctctttgctgcagccagattccctgaatgcccagaagggtcaagtatctctgctccatctcagacctcagtggatgtaagtctaattcaggacgttgagaggatcttggattattccctctgccaagaaacctggagcaaaatcagagcgggtcttccaatctctccagtggatctcagctatcttgctcctaaaaacccaggaaccggtcctgctttcaccataatcaatggtaccctaaaatactttgagaccagatacatcagagtcgatattgctgctccaatcctctcaagaatggtcggaatgatcagtggaactaccacagaaagggaactgtgggatgactgggcaccatatgaagacgtggaaattggacccaatggagttctgaggaccagttcaggatataagtttcctttatacatgattggacatggtatgttggactccgatcttcatcttagctcaaaggctcaggtgttcgaacatcctcacattcaagacgctgcttcgcaacttcctgatgatgagagtttattttttggtgatactgggctatccaaaaatccaatcgagcttgtagaaggttggttcagtagttggaaaagctctattgcctcttttttctttatcatagggttaatcattggactattcttggttctccgagttggtatccatctttgcattaaattaaagcacaccaagaaaagacagatttatacagacatagagatgaaccgacttggaaagagggccaagcgatctggatctggagcaacaaacttctcactactcaaacaagcaggtgacgtggaggagaatcccgggcctactagtatgaactccttctccacaagcgccttcggtccagttgccttctccctgggcctgctcctggtgttgcctgctgccttccctgccccagtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgaggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 12047 - skipped

SEQ ID NO: 12048 - DNA, 5166 bp, Artificial Sequence
  Synthetic Polynucleotide
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagccaccatggagacagacacactcctgctatgggtactgctgctctgggttccaggttccactggtgacgcggcccagccggccaggcgcgccgtacgaagcttggtaccgagctcggatccactagtccagtgtggtggaattctgcagatatccagcacagtggcggccgctcgagtctagagggcccgaacaaaaactcatctcagaagaggatctgaatagcgccgtcgaccatcatcatcatcatcattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 12049 - skipped

SEQ ID NO: 12050 - protein, 511 aa, Artificial Sequence
  Synthetic Polypeptide
MKCLLYLAFLFIGVNCKFTIVFPHNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 12051 - protein, 1001 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVEQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGISTMSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDLETDFYDYKDDDDKTSGSGEGRGSLLTCGDVEENPGPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 12052 - protein, 761 aa, Artificial Sequence
  Synthetic Polypeptide
MALPVTALLLPLALLLHAARPQVQLQESGPGLVKPSQTLSLTCTVSGGSINNNNYYWTWIRQHPGKGLEWIGYIYYSGSTFYNPSLKSRVTISVDTSKTQFSLKLSSVTAADTAVYYCAREDTMTGLDVWGQGTTVTVSSGGGGSGGGGSGGGGSDIQMTQSPSSLSASVGDRVTITCRASQSINNYLNWYQQKPGKAPTLLIYAASSLQSGVPSRFSGSRSGTDFTLTISSLQPEDFAAYFCQQTYSNPTFGQGTKVEVKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 12053 - skipped

SEQ ID NO: 12054 - protein, 169 aa, Artificial Sequence
  Synthetic Polypeptide
MKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 12055 - protein, 171 aa, Artificial Sequence
  Synthetic Polypeptide
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 12056 - protein, 148 aa, Artificial Sequence
  Synthetic Polypeptide
MEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGD

SEQ ID NO: 12057 - protein, 153 aa, Artificial Sequence
  Synthetic Polypeptide
MNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDR

SEQ ID NO: 12058 - protein, 206 aa, Artificial Sequence
  Synthetic Polypeptide
MLPASPTDRSIVLDNGYVCSWEGIPDDLRDCPKTEDMSKQHGAALKLPPDVLDEMECNAKKSGCVRGCLQCLALIKCTAKMRKYIPGRCHSYEGDKDIAQGGIGKELTIDIPEIPGFLDLAPMDQFVAQVDLCVDCSSRCLKGLANVQCSCKLYKWLPTRCTGFQAKIKKEADTVIGLEDALALGFDTIQACVAAGKCKDTVGRYS

SEQ ID NO: 12059 - protein, 169 aa, Artificial Sequence
  Synthetic Polypeptide
MAASEEADDDHVSLVKNYWRIGVGNERDVSLDRGGPPKLSKELLAEMHAIASNAGCSRVCLIGLSKIKCTPKMKTFLPGRCNTFAPKPATGDGPFAAAAAIPGFSDLTAMEQYKAQVAQCDCSNRCLVGLANIKCSAALKAALPQRCTTFATNIQKEGEVDSIKGYGRK

SEQ ID NO: 12060 - protein, 195 aa, Artificial Sequence
  Synthetic Polypeptide
MQPTENKQESQIEDIDRSTSLGLMCYEQCTGQSGLDLKCYKECADFTGDRNRGRKLPGKKLPLEVLKIMEANARRAGCTRGCLICLSKIKCTAKMKQYIPGRCHTYEGDKSIGQGGIGGPIVDIPEIIGFQNMEPMEQFIAQVDLCADCTTGCLKGLANVRCNDLLKKWLPDRCAGFANKIQSEVDNIKGLAGDR

SEQ ID NO: 12061 - protein, 170 aa, Artificial Sequence
  Synthetic Polypeptide
MKSIDSYENIDIVAVAGNFAAVDQDANRGGNLPGKKMPIEVLKEMEANAKRAGCVRGCLICLSHIKCTAKMKKFIPGRCHSYHGDADTKQGALEEVVDMPEIPGFVDMEPMEQFIAQVDKCEDCTTGCLKGLANVHCSDLLKKWLPQRCSQFADKIQSEVDTIKGLAGDR

SEQ ID NO: 12062 - protein, 193 aa, Artificial Sequence
  Synthetic Polypeptide
MNPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDLCADCTTGCLKGLANVKCSALLKKWLPDRCASFADKIQSEVDNIKGLAGDR

SEQ ID NO: 12063 - protein, 170 aa, Artificial Sequence
  Synthetic Polypeptide
MKPTENNDDIDIVGIASTFITTNTDADRGKMPGKKLPLAVLKEMEANAAKAGCSRGCLICLSKIKCTAKMKQFIPGRCHDYGGDKKTGQAALVGAIFDIPEIFGFLDMEPIEQFIAQVDLCAGCTTGCLKGLANIKCSELLKKWLPKRCTSFAYKMQKEMHNIKGMAGDR

SEQ ID NO: 12064 - protein, 170 aa, Artificial Sequence
  Synthetic Polypeptide
MKATENNDDIDIVGIASTFITTNTDADRGKMPGKRLPLAVLKEMEANAVKAGCSRGCLICLSKIKCTAKMKQYIPGRCHDYGGDKKTGQAAIEGAIDDIPEISGFKEMAPMEQFIAQVDLCADCTTGCLKGLANVKCSELLKKWLPKRCTSFATKMQKEIHNIKGMGGDR

SEQ ID NO: 12065 - protein, 196 aa, Artificial Sequence
  Synthetic Polypeptide
MNPTETQDGVDILGVEGKFGTETNLETDLFTIWEINGIIKSDRDTNRANADADRGKMPGKKLPLAVLIEMEANAFKAGCTRGCLICLSKIKCTAKMKEYIPGRCHDYGGDKKTGQAGIVGAIVDIPEISGFKELGPMEQFIAQVDLCADCTTGCLKGLANVKCSALLKKWLPDRCASFADKIQSEVHNIKGLAGDR

SEQ ID NO: 12066 - protein, 174 aa, Artificial Sequence
  Synthetic Polypeptide
MATINENFEDIDLVAIGGSFATDVDANRGGHGGHPGKKMPKEVLLEMEANAKRAGCHRGCLICLSHIKCTQKMKKFIPGRCHSYAGDKDSAQGGITEEETVDMPEIAGFKDLEPMEQFIAQVDLCVDCTTGCLKGLANVHCSDLLKKWLPSRCKTFASKIQSQVDTIKGLAGDR

SEQ ID NO: 12067 - protein, 193 aa, Artificial Sequence
  Synthetic Polypeptide
MNPTENNDHINIVGIEGKFGITDLETDLFTIWETNRMISTDNEQANTDSNRGKMPGKKLPLAVLIEMEANAFKAGCTRGCLICLSKIKCTAKMKKYIPGRCHDYGGDKKTGQAGIVGAIVDIPDISGFKEMGPMEQFIAQVDRCTDCTTGCLKGLANVKCSELLKKWLPDRCASFADKIQSEVHNIKGLAGDR

SEQ ID NO: 12068 - protein, 166 aa, Artificial Sequence
  Synthetic Polypeptide
MQPTENKKESYTEDTDVNGDHDRGRKLPGKKLPLEVLKIMEANARRAGCTRGCLICLSKIKCTAKMKQYIPGRCHTYEGDKSIGQAGIGGPIIDIPEIIGFKNMEPMEQFIAQVDLCADCTTGCLKGLANVRCNDLLKKWLPDRCAGFALKIQGEVENIKGMAGDR

SEQ ID NO: 12069 - protein, 206 aa, Artificial Sequence; identical to SEQ ID NO: 12058
  Synthetic Polypeptide

SEQ ID NO: 12070 - protein, 178 aa, Artificial Sequence
  Synthetic Polypeptide
MWAASEEADDDLVSLVKNYWGVGVSNERDVSLDRGGHGKLPKKLSVEILAEMEANAQKSNCSRGCLIGLSKIKCTPKMKKFLPGRCHEYSGDPKTGQGPLTAAAVIPGYSDLTAMEQFKLQVDKCDCSTQCLKGLANVKCSAALKAVLPTRCSQFATQIQAEVGTIKGKGKKPTPPIG

SEQ ID NO: 12071 - protein, 193 aa, Artificial Sequence
  Synthetic Polypeptide
MKPTEINEDLNIAAVASNFATTDLETDLFTNWETMNVISTDTEQVNTDADRGKLPGKKLPPDVLRELEANARRAGCTRGCLICLSHIKCTPKMKKFIPGRCHTYEGEKESAQGGIGEAIVDIPEIPGFKDKEPLDQFIAQVDLCADCTTGCLKGLANVQCSDLLKKWLPQRCTTFASKIQGRVDKIKGLAGDR

SEQ ID NO: 12072 - protein, 311 aa, Artificial Sequence
  Synthetic Polypeptide
MASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQ

SEQ ID NO: 12073 - protein, 550 aa, Artificial Sequence
  Synthetic Polypeptide
MEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAV

SEQ ID NO: 12074 - protein, 544 aa, Artificial Sequence
  Synthetic Polypeptide
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNG

SEQ ID NO: 12075 - protein, 544 aa, Artificial Sequence
  Synthetic Polypeptide
MADKNILYGPEPFYPLEDGTAGEQMFDALSRYADIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNDDLGGYQCLNNFISQNSDSNLDVKKFKPYSFNRDDQVALIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPFHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVIFLDEIPKGSTGKIDRKVLRQMLEKHTNG

SEQ ID NO: 12076 - protein, 544 aa, Artificial Sequence
  Synthetic Polypeptide
MADKNILYGPEPFYPLADGTAGEQMFDALSRYADISGCIALTNAHTKENVLYEEFLKLSCRLAESFKKYGLKQNDTIAVCSENGLQFFLPVIASLYLGIIAAPVSDKYIERELIHSLGIVKPRIIFCSKNTFQKVLNVKSKLKSVETIIILDLNEDLGGYQCLNNFISQNSDSNLDVKKFKPYSFNRDDQVALVMFSSGTTGVPKGVMLTHKNIVARFSLAKDPTFGNAINPTTAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDARPGSTGKIVPFHAVKVVDPTTGKILGPNEPGELYFKGAMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDFVSSQVSTAKWLRGGVKFLDEIPKGSTGKIDRKVLRQMFEKHTNG

SEQ ID NO: 12077 - protein, 544 aa, Artificial Sequence
  Synthetic Polypeptide
MADKNILYGPEPFYPLADGTAGEQMFYALSRYADISGCIALTNAHTKENVLYEEFLKLSCRLAESFKKYGLKQNDTIAVCSENGLQFFLPIIASLYLGIIAAPVSDKYIERELIHSLGIVKPRIIFCSKNTFQKVLNVKSKLKYVETIIILDLNEDLGGYQCLNNFISQNSDINLDVKKFKPYSFNRDDQVALVMFSSGTTGVSKGVMLTHKNIVARFSLAKDPTFGNAINPTTAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPNNDVRPGSTGKIVPFHAVKVVDPTTGKILGPNEPGELYFKGDMIMKGYYNNEEATKAIINKDGWLRSGDIAYYDNDGHFYIVDRLKSLIKYKGYQVAPAEIEGILLQHPYIVDAGVTGIPDEAAGELPAAGVVVQTGKYLNEQIVQNFVSSQVSTAKWLRGGVKFLDEIPKGSTGKIDRKVLRQMFEKHTNG

SEQ ID NO: 12078 - protein, 542 aa, Artificial Sequence
  Synthetic Polypeptide
MMKREKNVIYGPEPLHPLEDLTAGEMLFRALRKHSHLPQALVDVVGDESLSYKEFFEATVLLAQSLHNCGYKMNDVVSICAENNTRFFIPVIAAWYIGMIVAPVNESYIPDELCKVMGISKPQIVFTTKNILNKVLEVQSRTNFIKRIIILDTVENIHGCESLPNGISRYSDGNIANFKPLHFDPVEQVAAILCSSGTTGLPKGVMQTHQNICVRLIHALDPRAGTQLIPGVTVLVYLPFFHAFGFSITLGYFMVGLRVIMFRRFDQEAFLKAIQDYEVRSVINVPSVILFLSKSPLVDKYDLSSLRELCCGAAPLAKEVAEVAAKRLNLPGIRCGFGLTESTSANIHSLRDEFKSGSLGRVTPLMAAKIADRETGKALGPNQVGELCIKGPMVSKGYVNNVEATKEAIDDDGWLHSGDFGYYDEDEHFYVVDRYKELIKYKGSQVAPAELEEILLKNPCIRDVAVVGIPDLEAGELPSAFVVKQPGKEITAKEVYDYLAERVSHTKYLRGGVRFVDSIPRNVTGKITRKELLKQLLEKAGG

SEQ ID NO: 12079 - protein, 542 aa, Artificial Sequence
  Synthetic Polypeptide
MVKREKNVIYGPEPLHPLEDLTAGEMLFRALRKHSHLPQALVDVVGDESLSYKEFFEATVLLAQSLHNCGYKMNDVVSICAENNTRFFIPVIAAWYIGMIVAPVNESYIPDELCKVMGISKPQIVFTTKNILNKVLEVQSRTNFIKRIIILDTVENIHGCESLPNFISRYSDGNIANFKPLHFDPVEQVAAILCSSGTTGLPKGVMQTHQNICVRLIHALDPRYGTQLIPGVTVLVYLPFFHAFGFHITLGYFMVGLRVIMFRRFDQEAFLKAIQDYEVRSVINVPSVILFLSKSPLVDKYDLSSLRELCCGAAPLAKEVAEVAAKRLNLPGIRCGFGLTESTSAIIQTLGDEFKSGSLGRVTPLMAAKIADRETGKALGPNQVGELCIKGPMVSKGYVNNVEATKEAIDDDGWLHSGDFGYYDEDEHFYVVDRYKELIKYKGSQVAPAELEEILLKNPCIRDVAVVGIPDLEAGELPSAFVVKQPGTEITAKEVYDYLAERVSHTKYLRGGVRFVDSIPRNVTGKITRKELLKQLLVKAGG

SEQ ID NO: 12080 - protein, 490 aa, Artificial Sequence
  Synthetic Polypeptide
MIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPG

SEQ ID NO: 12081 - protein, 236 aa, Artificial Sequence
  Synthetic Polypeptide
MVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 12082 - protein, 239 aa, Artificial Sequence
  Synthetic Polypeptide
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 12083 - skipped

SEQ ID NO: 12084 - protein, 273 aa, Artificial Sequence
  Synthetic Polypeptide
MNSFSTSAFGPVAFSLGLLLVLPAAFPAPVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEKIEVMYPPPYLDNEKSNGTIIHVKGKHLCPSPLFPGPSKPFWVLVVVGGVLACYSLLVTVAFIIFWVRSKRS

SEQ ID NO: 12085 - protein, 264 aa, Artificial Sequence
  Synthetic Polypeptide
MALPVTALLLPLALLLHAARPMKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEKIEVMYPPPYLDNEKSNGTIIHVKGKHLCPSPLFPGPSKPFWVLVVVGGVLACYSLLVTVAFIIFWVRSKRS

SEQ ID NO: 12086 - protein, 266 aa, Artificial Sequence
  Synthetic Polypeptide
MALPVTALLLPLALLLHAARPMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEKIEVMYPPPYLDNEKSNGTIIHVKGKHLCPSPLFPGPSKPFWVLVVVGGVLACYSLLVTVAFIIFWVRSKRS

SEQ ID NO: 12087 - protein, 243 aa, Artificial Sequence
  Synthetic Polypeptide
MALPVTALLLPLALLLHAARPMEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEKIEVMYPPPYLDNEKSNGTIIHVKGKHLCPSPLFPGPSKPFWVLVVVGGVLACYSLLVTVAFIIFWVRSKRS

SEQ ID NO: 12088 - protein, 248 aa, Artificial Sequence
  Synthetic Polypeptide
MALPVTALLLPLALLLHAARPMNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEKIEVMYPPPYLDNEKSNGTIIHVKGKHLCPSPLFPGPSKPFWVLVVVGGVLACYSLLVTVAFIIFWVRSKRS

SEQ ID NO: 12089 - protein, 301 aa, Artificial Sequence
  Synthetic Polypeptide
MALPVTALLLPLALLLHAARPMLPASPTDRSIVLDNGYVCSWEGIPDDLRDCPKTEDMSKQHGAALKLPPDVLDEMECNAKKSGCVRGCLQCLALIKCTAKMRKYIPGRCHSYEGDKDIAQGGIGKELTIDIPEIPGFLDLAPMDQFVAQVDLCVDCSSRCLKGLANVQCSCKLYKWLPTRCTGFQAKIKKEADTVIGLEDALALGFDTIQACVAAGKCKDTVGRYSLEKIEVMYPPPYLDNEKSNGTIIHVKGKHLCPSPLFPGPSKPFWVLVVVGGVLACYSLLVTVAFIIFWVRSKRS

SEQ ID NO: 12090 - protein, 264 aa, Artificial Sequence
  Synthetic Polypeptide
MALPVTALLLPLALLLHAARPMAASEEADDDHVSLVKNYWRIGVGNERDVSLDRGGPPKLSKELLAEMHAIASNAGCSRVCLIGLSKIKCTPKMKTFLPGRCNTFAPKPATGDGPFAAAAAIPGFSDLTAMEQYKAQVAQCDCSNRCLVGLANIKCSAALKAALPQRCTTFATNIQKEGEVDSIKGYGRKLEKIEVMYPPPYLDNEKSNGTIIHVKGKHLCPSPLFPGPSKPFWVLVVVGGVLACYSLLVTVAFIIFWVRSKRS

SEQ ID NO: 12091 - protein, 290 aa, Artificial Sequence
  Synthetic Polypeptide
MALPVTALLLPLALLLHAARPMQPTENKQESQIEDIDRSTSLGLMCYEQCTGQSGLDLKCYKECADFTGDRNRGRKLPGKKLPLEVLKIMEANARRAGCTRGCLICLSKIKCTAKMKQYIPGRCHTYEGDKSIGQGGIGGPIVDIPEIIGFQNMEPMEQFIAQVDLCADCTTGCLKGLANVRCNDLLKKWLPDRCAGFANKIQSEVDNIKGLAGDRLEKIEVMYPPPYLDNEKSNGTIIHVKGKHLCPSPLFPGPSKPFWVLVVVGGVLACYSLLVTVAFIIFWVRSKRS

SEQ ID NO: 12092 - protein, 265 aa, Artificial Sequence
  Synthetic Polypeptide
MALPVTALLLPLALLLHAARPMKSIDSYENIDIVAVAGNFAAVDQDANRGGNLPGKKMPIEVLKEMEANAKRAGCVRGCLICLSHIKCTAKMKKFIPGRCHSYHGDADTKQGALEEVVDMPEIPGFVDMEPMEQFIAQVDKCEDCTTGCLKGLANVHCSDLLKKWLPQRCSQFADKIQSEVDTIKGLAGDRLEKIEVMYPPPYLDNEKSNGTIIHVKGKHLCPSPLFPGPSKPFWVLVVVGGVLACYSLLVTVAFIIFWVRSKRS

SEQ ID NO: 12093 - protein, 288 aa, Artificial Sequence
  Synthetic Polypeptide
MALPVTALLLPLALLLHAARPMNPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDLCADCTTGCLKGLANVKCSALLKKWLPDRCASFADKIQSEVDNIKGLAGDRLEKIEVMYPPPYLDNEKSNGTIIHVKGKHLCPSPLFPGPSKPFWVLVVVGGVLACYSLLVTVAFIIFWVRSKRS

SEQ ID NO: 12094 - protein, 265 aa, Artificial Sequence
  Synthetic Polypeptide
MALPVTALLLPLALLLHAARPMKPTENNDDIDIVGIASTFITTNTDADRGKMPGKKLPLAVLKEMEANAAKAGCSRGCLICLSKIKCTAKMKQFIPGRCHDYGGDKKTGQAALVGAIFDIPEIFGFLDMEPIEQFIAQVDLCAGCTTGCLKGLANIKCSELLKKWLPKRCTSFAYKMQKEMHNIKGMAGDRLEKIEVMYPPPYLDNEKSNGTIIHVKGKHLCPSPLFPGPSKPFWVLVVVGGVLACYSLLVTVAFIIFWVRSKRS

SEQ ID NO: 12095 - protein, 265 aa, Artificial Sequence
  Synthetic Polypeptide
MALPVTALLLPLALLLHAARPMKATENNDDIDIVGIASTFITTNTDADRGKMPGKRLPLAVLKEMEANAVKAGCSRGCLICLSKIKCTAKMKQYIPGRCHDYGGDKKTGQAAIEGAIDDIPEISGFKEMAPMEQFIAQVDLCADCTTGCLKGLANVKCSELLKKWLPKRCTSFATKMQKEIHNIKGMGGDRLEKIEVMYPPPYLDNEKSNGTIIHVKGKHLCPSPLFPGPSKPFWVLVVVGGVLACYSLLVTVAFIIFWVRSKRS

SEQ ID NO: 12096 - protein, 291 aa, Artificial Sequence
  Synthetic Polypeptide
MALPVTALLLPLALLLHAARPMNPTETQDGVDILGVEGKFGTETNLETDLFTIWEINGIIKSDRDTNRANADADRGKMPGKKLPLAVLIEMEANAFKAGCTRGCLICLSKIKCTAKMKEYIPGRCHDYGGDKKTGQAGIVGAIVDIPEISGFKELGPMEQFIAQVDLCADCTTGCLKGLANVKCSALLKKWLPDRCASFADKIQSEVHNIKGLAGDRLEKIEVMYPPPYLDNEKSNGTIIHVKGKHLCPSPLFPGPSKPFWVLVVVGGVLACYSLLVTVAFIIFWVRSKRS

SEQ ID NO: 12097 - protein, 269 aa, Artificial Sequence
  Synthetic Polypeptide
MALPVTALLLPLALLLHAARPMATINENFEDIDLVAIGGSFATDVDANRGGHGGHPGKKMPKEVLLEMEANAKRAGCHRGCLICLSHIKCTQKMKKFIPGRCHSYAGDKDSAQGGITEEETVDMPEIAGFKDLEPMEQFIAQVDLCVDCTTGCLKGLANVHCSDLLKKWLPSRCKTFASKIQSQVDTIKGLAGDRLEKIEVMYPPPYLDNEKSNGTIIHVKGKHLCPSPLFPGPSKPFWVLVVVGGVLACYSLLVTVAFIIFWVRSKRS

SEQ ID NO: 12098 - protein, 288 aa, Artificial Sequence
  Synthetic Polypeptide
MALPVTALLLPLALLLHAARPMNPTENNDHINIVGIEGKFGITDLETDLFTIWETNRMISTDNEQANTDSNRGKMPGKKLPLAVLIEMEANAFKAGCTRGCLICLSKIKCTAKMKKYIPGRCHDYGGDKKTGQAGIVGAIVDIPDISGFKEMGPMEQFIAQVDRCTDCTTGCLKGLANVKCSELLKKWLPDRCASFADKIQSEVHNIKGLAGDRLEKIEVMYPPPYLDNEKSNGTIIHVKGKHLCPSPLFPGPSKPFWVLVVVGGVLACYSLLVTVAFIIFWVRSKRS

SEQ ID NO: 12099 - protein, 261 aa, Artificial Sequence
  Synthetic Polypeptide
MALPVTALLLPLALLLHAARPMQPTENKKESYTEDTDVNGDHDRGRKLPGKKLPLEVLKIMEANARRAGCTRGCLICLSKIKCTAKMKQYIPGRCHTYEGDKSIGQAGIGGPIIDIPEIIGFKNMEPMEQFIAQVDLCADCTTGCLKGLANVRCNDLLKKWLPDRCAGFALKIQGEVENIKGMAGDRLEKIEVMYPPPYLDNEKSNGTIIHVKGKHLCPSPLFPGPSKPFWVLVVVGGVLACYSLLVTVAFIIFWVRSKRS

SEQ ID NO: 12100 - protein, 301 aa, Artificial Sequence; identical to SEQ ID NO: 12089
  Synthetic Polypeptide

SEQ ID NO: 12101 - protein, 273 aa, Artificial Sequence
  Synthetic Polypeptide
MALPVTALLLPLALLLHAARPMWAASEEADDDLVSLVKNYWGVGVSNERDVSLDRGGHGKLPKKLSVEILAEMEANAQKSNCSRGCLIGLSKIKCTPKMKKFLPGRCHEYSGDPKTGQGPLTAAAVIPGYSDLTAMEQFKLQVDKCDCSTQCLKGLANVKCSAALKAVLPTRCSQFATQIQAEVGTIKGKGKKPTPPIGLEKIEVMYPPPYLDNEKSNGTIIHVKGKHLCPSPLFPGPSKPFWVLVVVGGVLACYSLLVTVAFIIFWVRSKRS

SEQ ID NO: 12102 - protein, 288 aa, Artificial Sequence
  Synthetic Polypeptide
MALPVTALLLPLALLLHAARPMKPTEINEDLNIAAVASNFATTDLETDLFTNWETMNVISTDTEQVNTDADRGKLPGKKLPPDVLRELEANARRAGCTRGCLICLSHIKCTPKMKKFIPGRCHTYEGEKESAQGGIGEAIVDIPEIPGFKDKEPLDQFIAQVDLCADCTTGCLKGLANVQCSDLLKKWLPQRCTTFASKIQGRVDKIKGLAGDRLEKIEVMYPPPYLDNEKSNGTIIHVKGKHLCPSPLFPGPSKPFWVLVVVGGVLACYSLLVTVAFIIFWVRSKRS

SEQ ID NO: 12103 - protein, 406 aa, Artificial Sequence
  Synthetic Polypeptide
MALPVTALLLPLALLLHAARPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEKIEVMYPPPYLDNEKSNGTIIHVKGKHLCPSPLFPGPSKPFWVLVVVGGVLACYSLLVTVAFIIFWVRSKRS

SEQ ID NO: 12104 - protein, 645 aa, Artificial Sequence
  Synthetic Polypeptide
MALPVTALLLPLALLLHAARPMEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAVLEKIEVMYPPPYLDNEKSNGTIIHVKGKHLCPSPLFPGPSKPFWVLVVVGGVLACYSLLVTVAFIIFWVRSKRS

SEQ ID NO: 12105 - protein, 639 aa, Artificial Sequence
  Synthetic Polypeptide
MALPVTALLLPLALLLHAARPMADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGLEKIEVMYPPPYLDNEKSNGTIIHVKGKHLCPSPLFPGPSKPFWVLVVVGGVLACYSLLVTVAFIIFWVRSKRS

SEQ ID NO: 12106 - protein, 639 aa, Artificial Sequence
  Synthetic Polypeptide
MALPVTALLLPLALLLHAARPMADKNILYGPEPFYPLEDGTAGEQMFDALSRYADIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNDDLGGYQCLNNFISQNSDSNLDVKKFKPYSFNRDDQVALIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPFHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVIFLDEIPKGSTGKIDRKVLRQMLEKHTNGLEKIEVMYPPPYLDNEKSNGTIIHVKGKHLCPSPLFPGPSKPFWVLVVVGGVLACYSLLVTVAFIIFWVRSKRS

SEQ ID NO: 12107 - protein, 639 aa, Artificial Sequence
  Synthetic Polypeptide
MALPVTALLLPLALLLHAARPMADKNILYGPEPFYPLADGTAGEQMFDALSRYADISGCIALTNAHTKENVLYEEFLKLSCRLAESFKKYGLKQNDTIAVCSENGLQFFLPVIASLYLGIIAAPVSDKYIERELIHSLGIVKPRIIFCSKNTFQKVLNVKSKLKSVETIIILDLNEDLGGYQCLNNFISQNSDSNLDVKKFKPYSFNRDDQVALVMFSSGTTGVPKGVMLTHKNIVARFSLAKDPTFGNAINPTTAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDARPGSTGKIVPFHAVKVVDPTTGKILGPNEPGELYFKGAMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDFVSSQVSTAKWLRGGVKFLDEIPKGSTGKIDRKVLRQMFEKHTNGLEKIEVMYPPPYLDNEKSNGTIIHVKGKHLCPSPLFPGPSKPFWVLVVVGGVLACYSLLVTVAFIIFWVRSKRS

SEQ ID NO: 12108 - protein, 639 aa, Artificial Sequence
  Synthetic Polypeptide
MALPVTALLLPLALLLHAARPMADKNILYGPEPFYPLADGTAGEQMFYALSRYADISGCIALTNAHTKENVLYEEFLKLSCRLAESFKKYGLKQNDTIAVCSENGLQFFLPIIASLYLGIIAAPVSDKYIERELIHSLGIVKPRIIFCSKNTFQKVLNVKSKLKYVETIIILDLNEDLGGYQCLNNFISQNSDINLDVKKFKPYSFNRDDQVALVMFSSGTTGVSKGVMLTHKNIVARFSLAKDPTFGNAINPTTAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPNNDVRPGSTGKIVPFHAVKVVDPTTGKILGPNEPGELYFKGDMIMKGYYNNEEATKAIINKDGWLRSGDIAYYDNDGHFYIVDRLKSLIKYKGYQVAPAEIEGILLQHPYIVDAGVTGIPDEAAGELPAAGVVVQTGKYLNEQIVQNFVSSQVSTAKWLRGGVKFLDEIPKGSTGKIDRKVLRQMFEKHTNGLEKIEVMYPPPYLDNEKSNGTIIHVKGKHLCPSPLFPGPSKPFWVLVVVGGVLACYSLLVTVAFIIFWVRSKRS

SEQ ID NO: 12109 - protein, 637 aa, Artificial Sequence
  Synthetic Polypeptide
MALPVTALLLPLALLLHAARPMMKREKNVIYGPEPLHPLEDLTAGEMLFRALRKHSHLPQALVDVVGDESLSYKEFFEATVLLAQSLHNCGYKMNDVVSICAENNTRFFIPVIAAWYIGMIVAPVNESYIPDELCKVMGISKPQIVFTTKNILNKVLEVQSRTNFIKRIIILDTVENIHGCESLPNGISRYSDGNIANFKPLHFDPVEQVAAILCSSGTTGLPKGVMQTHQNICVRLIHALDPRAGTQLIPGVTVLVYLPFFHAFGFSITLGYFMVGLRVIMFRRFDQEAFLKAIQDYEVRSVINVPSVILFLSKSPLVDKYDLSSLRELCCGAAPLAKEVAEVAAKRLNLPGIRCGFGLTESTSANIHSLRDEFKSGSLGRVTPLMAAKIADRETGKALGPNQVGELCIKGPMVSKGYVNNVEATKEAIDDDGWLHSGDFGYYDEDEHFYVVDRYKELIKYKGSQVAPAELEEILLKNPCIRDVAVVGIPDLEAGELPSAFVVKQPGKEITAKEVYDYLAERVSHTKYLRGGVRFVDSIPRNVTGKITRKELLKQLLEKAGGLEKIEVMYPPPYLDNEKSNGTIIHVKGKHLCPSPLFPGPSKPFWVLVVVGGVLACYSLLVTVAFIIFWVRSKRS

SEQ ID NO: 12110 - protein, 637 aa, Artificial Sequence
  Synthetic Polypeptide
MALPVTALLLPLALLLHAARPMVKREKNVIYGPEPLHPLEDLTAGEMLFRALRKHSHLPQALVDVVGDESLSYKEFFEATVLLAQSLHNCGYKMNDVVSICAENNTRFFIPVIAAWYIGMIVAPVNESYIPDELCKVMGISKPQIVFTTKNILNKVLEVQSRTNFIKRIIILDTVENIHGCESLPNFISRYSDGNIANFKPLHFDPVEQVAAILCSSGTTGLPKGVMQTHQNICVRLIHALDPRYGTQLIPGVTVLVYLPFFHAFGFHITLGYFMVGLRVIMFRRFDQEAFLKAIQDYEVRSVINVPSVILFLSKSPLVDKYDLSSLRELCCGAAPLAKEVAEVAAKRLNLPGIRCGFGLTESTSAIIQTLGDEFKSGSLGRVTPLMAAKIADRETGKALGPNQVGELCIKGPMVSKGYVNNVEATKEAIDDDGWLHSGDFGYYDEDEHFYVVDRYKELIKYKGSQVAPAELEEILLKNPCIRDVAVVGIPDLEAGELPSAFVVKQPGTEITAKEVYDYLAERVSHTKYLRGGVRFVDSIPRNVTGKITRKELLKQLLVKAGGLEKIEVMYPPPYLDNEKSNGTIIHVKGKHLCPSPLFPGPSKPFWVLVVVGGVLACYSLLVTVAFIIFWVRSKRS

SEQ ID NO: 12111 - protein, 585 aa, Artificial Sequence
  Synthetic Polypeptide
MALPVTALLLPLALLLHAARPMIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGLEKIEVMYPPPYLDNEKSNGTIIHVKGKHLCPSPLFPGPSKPFWVLVVVGGVLACYSLLVTVAFIIFWVRSKRS

SEQ ID NO: 12112 - protein, 331 aa, Artificial Sequence
  Synthetic Polypeptide
MALPVTALLLPLALLLHAARPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYKLEKIEVMYPPPYLDNEKSNGTIIHVKGKHLCPSPLFPGPSKPFWVLVVVGGVLACYSLLVTVAFIIFWVRSKRS

SEQ ID NO: 12113 - protein, 334 aa, Artificial Sequence
  Synthetic Polypeptide
MALPVTALLLPLALLLHAARPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEKIEVMYPPPYLDNEKSNGTIIHVKGKHLCPSPLFPGPSKPFWVLVVVGGVLACYSLLVTVAFIIFWVRSKRS

SEQ ID NO: 12114 - skipped

SEQ ID NO: 12115 - protein, 279 aa, Artificial Sequence
  Synthetic Polypeptide
MNSFSTSAFGPVAFSLGLLLVLPAAFPAPVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEAKPTTTPAPRPPTPAPTIASQPLSLRPEACRPAAGGAVHTRGLDFACDIYIWAPLAGTCGVLLLSLVITLYCKRGRKK

SEQ ID NO: 12116 - protein, 270 aa, Artificial Sequence
  Synthetic Polypeptide
MALPVTALLLPLALLLHAARPMKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEAKPTTTPAPRPPTPAPTIASQPLSLRPEACRPAAGGAVHTRGLDFACDIYIWAPLAGTCGVLLLSLVITLYCKRGRKK

SEQ ID NO: 12117 - protein, 272 aa, Artificial Sequence
  Synthetic Polypeptide
MALPVTALLLPLALLLHAARPMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEAKPTTTPAPRPPTPAPTIASQPLSLRPEACRPAAGGAVHTRGLDFACDIYIWAPLAGTCGVLLLSLVITLYCKRGRKK

SEQ ID NO: 12118 - protein, 249 aa, Artificial Sequence
  Synthetic Polypeptide
MALPVTALLLPLALLLHAARPMEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEAKPTTTPAPRPPTPAPTIASQPLSLRPEACRPAAGGAVHTRGLDFACDIYIWAPLAGTCGVLLLSLVITLYCKRGRKK

SEQ ID NO: 12119 - protein, 254 aa, Artificial Sequence
  Synthetic Polypeptide
MALPVTALLLPLALLLHAARPMNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEAKPTTTPAPRPPTPAPTIASQPLSLRPEACRPAAGGAVHTRGLDFACDIYIWAPLAGTCGVLLLSLVITLYCKRGRKK

SEQ ID NO: 12120 - protein, 307 aa, Artificial Sequence
  Synthetic Polypeptide
MALPVTALLLPLALLLHAARPMLPASPTDRSIVLDNGYVCSWEGIPDDLRDCPKTEDMSKQHGAALKLPPDVLDEMECNAKKSGCVRGCLQCLALIKCTAKMRKYIPGRCHSYEGDKDIAQGGIGKELTIDIPEIPGFLDLAPMDQFVAQVDLCVDCSSRCLKGLANVQCSCKLYKWLPTRCTGFQAKIKKEADTVIGLEDALALGFDTIQACVAAGKCKDTVGRYSLEAKPTTTPAPRPPTPAPTIASQPLSLRPEACRPAAGGAVHTRGLDFACDIYIWAPLAGTCGVLLLSLVITLYCKRGRKK

SEQ ID NO: 12121 - protein, 270 aa, Artificial Sequence
  Synthetic Polypeptide
MALPVTALLLPLALLLHAARPMAASEEADDDHVSLVKNYWRIGVGNERDVSLDRGGPPKLSKELLAEMHAIASNAGCSRVCLIGLSKIKCTPKMKTFLPGRCNTFAPKPATGDGPFAAAAAIPGFSDLTAMEQYKAQVAQCDCSNRCLVGLANIKCSAALKAALPQRCTTFATNIQKEGEVDSIKGYGRKLEAKPTTTPAPRPPTPAPTIASQPLSLRPEACRPAAGGAVHTRGLDFACDIYIWAPLAGTCGVLLLSLVITLYCKRGRKK

SEQ ID NO: 12122 - protein, 296 aa, Artificial Sequence
  Synthetic Polypeptide
MALPVTALLLPLALLLHAARPMQPTENKQESQIEDIDRSTSLGLMCYEQCTGQSGLDLKCYKECADFTGDRNRGRKLPGKKLPLEVLKIMEANARRAGCTRGCLICLSKIKCTAKMKQYIPGRCHTYEGDKSIGQGGIGGPIVDIPEIIGFQNMEPMEQFIAQVDLCADCTTGCLKGLANVRCNDLLKKWLPDRCAGFANKIQSEVDNIKGLAGDRLEAKPTTTPAPRPPTPAPTIASQPLSLRPEACRPAAGGAVHTRGLDFACDIYIWAPLAGTCGVLLLSLVITLYCKRGRKK

SEQ ID NO: 12123 - protein, 271 aa, Artificial Sequence
  Synthetic Polypeptide
MALPVTALLLPLALLLHAARPMKSIDSYENIDIVAVAGNFAAVDQDANRGGNLPGKKMPIEVLKEMEANAKRAGCVRGCLICLSHIKCTAKMKKFIPGRCHSYHGDADTKQGALEEVVDMPEIPGFVDMEPMEQFIAQVDKCEDCTTGCLKGLANVHCSDLLKKWLPQRCSQFADKIQSEVDTIKGLAGDRLEAKPTTTPAPRPPTPAPTIASQPLSLRPEACRPAAGGAVHTRGLDFACDIYIWAPLAGTCGVLLLSLVITLYCKRGRKK

SEQ ID NO: 12124 - protein, 294 aa, Artificial Sequence
  Synthetic Polypeptide
MALPVTALLLPLALLLHAARPMNPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDLCADCTTGCLKGLANVKCSALLKKWLPDRCASFADKIQSEVDNIKGLAGDRLEAKPTTTPAPRPPTPAPTIASQPLSLRPEACRPAAGGAVHTRGLDFACDIYIWAPLAGTCGVLLLSLVITLYCKRGRKK

SEQ ID NO: 12125 - protein, 271 aa, Artificial Sequence
  Synthetic Polypeptide
MALPVTALLLPLALLLHAARPMKPTENNDDIDIVGIASTFITTNTDADRGKMPGKKLPLAVLKEMEANAAKAGCSRGCLICLSKIKCTAKMKQFIPGRCHDYGGDKKTGQAALVGAIFDIPEIFGFLDMEPIEQFIAQVDLCAGCTTGCLKGLANIKCSELLKKWLPKRCTSFAYKMQKEMHNIKGMAGDRLEAKPTTTPAPRPPTPAPTIASQPLSLRPEACRPAAGGAVHTRGLDFACDIYIWAPLAGTCGVLLLSLVITLYCKRGRKK

SEQ ID NO: 12126 - protein, 271 aa, Artificial Sequence
  Synthetic Polypeptide
MALPVTALLLPLALLLHAARPMKATENNDDIDIVGIASTFITTNTDADRGKMPGKRLPLAVLKEMEANAVKAGCSRGCLICLSKIKCTAKMKQYIPGRCHDYGGDKKTGQAAIEGAIDDIPEISGFKEMAPMEQFIAQVDLCADCTTGCLKGLANVKCSELLKKWLPKRCTSFATKMQKEIHNIKGMGGDRLEAKPTTTPAPRPPTPAPTIASQPLSLRPEACRPAAGGAVHTRGLDFACDIYIWAPLAGTCGVLLLSLVITLYCKRGRKK

SEQ ID NO: 12127 - protein, 297 aa, Artificial Sequence
  Synthetic Polypeptide
MALPVTALLLPLALLLHAARPMNPTETQDGVDILGVEGKFGTETNLETDLFTIWEINGIIKSDRDTNRANADADRGKMPGKKLPLAVLIEMEANAFKAGCTRGCLICLSKIKCTAKMKEYIPGRCHDYGGDKKTGQAGIVGAIVDIPEISGFKELGPMEQFIAQVDLCADCTTGCLKGLANVKCSALLKKWLPDRCASFADKIQSEVHNIKGLAGDRLEAKPTTTPAPRPPTPAPTIASQPLSLRPEACRPAAGGAVHTRGLDFACDIYIWAPLAGTCGVLLLSLVITLYCKRGRKK

SEQ ID NO: 12128 - protein, 275 aa, Artificial Sequence
  Synthetic Polypeptide
MALPVTALLLPLALLLHAARPMATINENFEDIDLVAIGGSFATDVDANRGGHGGHPGKKMPKEVLLEMEANAKRAGCHRGCLICLSHIKCTQKMKKFIPGRCHSYAGDKDSAQGGITEEETVDMPEIAGFKDLEPMEQFIAQVDLCVDCTTGCLKGLANVHCSDLLKKWLPSRCKTFASKIQSQVDTIKGLAGDRLEAKPTTTPAPRPPTPAPTIASQPLSLRPEACRPAAGGAVHTRGLDFACDIYIWAPLAGTCGVLLLSLVITLYCKRGRKK

SEQ ID NO: 12129 - protein, 294 aa, Artificial Sequence
  Synthetic Polypeptide
MALPVTALLLPLALLLHAARPMNPTENNDHINIVGIEGKFGITDLETDLFTIWETNRMISTDNEQANTDSNRGKMPGKKLPLAVLIEMEANAFKAGCTRGCLICLSKIKCTAKMKKYIPGRCHDYGGDKKTGQAGIVGAIVDIPDISGFKEMGPMEQFIAQVDRCTDCTTGCLKGLANVKCSELLKKWLPDRCASFADKIQSEVHNIKGLAGDRLEAKPTTTPAPRPPTPAPTIASQPLSLRPEACRPAAGGAVHTRGLDFACDIYIWAPLAGTCGVLLLSLVITLYCKRGRKK

SEQ ID NO: 12130 - protein, 267 aa, Artificial Sequence
  Synthetic Polypeptide
MALPVTALLLPLALLLHAARPMQPTENKKESYTEDTDVNGDHDRGRKLPGKKLPLEVLKIMEANARRAGCTRGCLICLSKIKCTAKMKQYIPGRCHTYEGDKSIGQAGIGGPIIDIPEIIGFKNMEPMEQFIAQVDLCADCTTGCLKGLANVRCNDLLKKWLPDRCAGFALKIQGEVENIKGMAGDRLEAKPTTTPAPRPPTPAPTIASQPLSLRPEACRPAAGGAVHTRGLDFACDIYIWAPLAGTCGVLLLSLVITLYCKRGRKK

SEQ ID NO: 12131 - protein, 307 aa, Artificial Sequence; identical to SEQ ID NO: 12120
  Synthetic Polypeptide

SEQ ID NO: 12132 - protein, 279 aa, Artificial Sequence
  Synthetic Polypeptide
MALPVTALLLPLALLLHAARPMWAASEEADDDLVSLVKNYWGVGVSNERDVSLDRGGHGKLPKKLSVEILAEMEANAQKSNCSRGCLIGLSKIKCTPKMKKFLPGRCHEYSGDPKTGQGPLTAAAVIPGYSDLTAMEQFKLQVDKCDCSTQCLKGLANVKCSAALKAVLPTRCSQFATQIQAEVGTIKGKGKKPTPPIGLEAKPTTTPAPRPPTPAPTIASQPLSLRPEACRPAAGGAVHTRGLDFACDIYIWAPLAGTCGVLLLSLVITLYCKRGRKK

SEQ ID NO: 12133 - protein, 294 aa, Artificial Sequence
  Synthetic Polypeptide
MALPVTALLLPLALLLHAARPMKPTEINEDLNIAAVASNFATTDLETDLFTNWETMNVISTDTEQVNTDADRGKLPGKKLPPDVLRELEANARRAGCTRGCLICLSHIKCTPKMKKFIPGRCHTYEGEKESAQGGIGEAIVDIPEIPGFKDKEPLDQFIAQVDLCADCTTGCLKGLANVQCSDLLKKWLPQRCTTFASKIQGRVDKIKGLAGDRLEAKPTTTPAPRPPTPAPTIASQPLSLRPEACRPAAGGAVHTRGLDFACDIYIWAPLAGTCGVLLLSLVITLYCKRGRKK

SEQ ID NO: 12134 - protein, 412 aa, Artificial Sequence
  Synthetic Polypeptide
MALPVTALLLPLALLLHAARPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEAKPTTTPAPRPPTPAPTIASQPLSLRPEACRPAAGGAVHTRGLDFACDIYIWAPLAGTCGVLLLSLVITLYCKRGRKK

SEQ ID NO: 12135 - protein, 651 aa, Artificial Sequence
  Synthetic Polypeptide
MALPVTALLLPLALLLHAARPMEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAVLEAKPTTTPAPRPPTPAPTIASQPLSLRPEACRPAAGGAVHTRGLDFACDIYIWAPLAGTCGVLLLSLVITLYCKRGRKK

SEQ ID NO: 12136 - protein, 645 aa, Artificial Sequence
  Synthetic Polypeptide
MALPVTALLLPLALLLHAARPMADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGLEAKPTTTPAPRPPTPAPTIASQPLSLRPEACRPAAGGAVHTRGLDFACDIYIWAPLAGTCGVLLLSLVITLYCKRGRKK

SEQ ID NO: 12137 - protein, 645 aa, Artificial Sequence
  Synthetic Polypeptide
MALPVTALLLPLALLLHAARPMADKNILYGPEPFYPLEDGTAGEQMFDALSRYADIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNDDLGGYQCLNNFISQNSDSNLDVKKFKPYSFNRDDQVALIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPFHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVIFLDEIPKGSTGKIDRKVLRQMLEKHTNGLEAKPTTTPAPRPPTPAPTIASQPLSLRPEACRPAAGGAVHTRGLDFACDIYIWAPLAGTCGVLLLSLVITLYCKRGRKK

SEQ ID NO: 12138 - protein, 645 aa, Artificial Sequence
  Synthetic Polypeptide
MALPVTALLLPLALLLHAARPMADKNILYGPEPFYPLADGTAGEQMFDALSRYADISGCIALTNAHTKENVLYEEFLKLSCRLAESFKKYGLKQNDTIAVCSENGLQFFLPVIASLYLGIIAAPVSDKYIERELIHSLGIVKPRIIFCSKNTFQKVLNVKSKLKSVETIIILDLNEDLGGYQCLNNFISQNSDSNLDVKKFKPYSFNRDDQVALVMFSSGTTGVPKGVMLTHKNIVARFSLAKDPTFGNAINPTTAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDARPGSTGKIVPFHAVKVVDPTTGKILGPNEPGELYFKGAMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDFVSSQVSTAKWLRGGVKFLDEIPKGSTGKIDRKVLRQMFEKHTNGLEAKPTTTPAPRPPTPAPTIASQPLSLRPEACRPAAGGAVHTRGLDFACDIYIWAPLAGTCGVLLLSLVITLYCKRGRKK

SEQ ID NO: 12139 - protein, 645 aa, Artificial Sequence
  Synthetic Polypeptide
MALPVTALLLPLALLLHAARPMADKNILYGPEPFYPLADGTAGEQMFYALSRYADISGCIALTNAHTKENVLYEEFLKLSCRLAESFKKYGLKQNDTIAVCSENGLQFFLPIIASLYLGIIAAPVSDKYIERELIHSLGIVKPRIIFCSKNTFQKVLNVKSKLKYVETIIILDLNEDLGGYQCLNNFISQNSDINLDVKKFKPYSFNRDDQVALVMFSSGTTGVSKGVMLTHKNIVARFSLAKDPTFGNAINPTTAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPNNDVRPGSTGKIVPFHAVKVVDPTTGKILGPNEPGELYFKGDMIMKGYYNNEEATKAIINKDGWLRSGDIAYYDNDGHFYIVDRLKSLIKYKGYQVAPAEIEGILLQHPYIVDAGVTGIPDEAAGELPAAGVVVQTGKYLNEQIVQNFVSSQVSTAKWLRGGVKFLDEIPKGSTGKIDRKVLRQMFEKHTNGLEAKPTTTPAPRPPTPAPTIASQPLSLRPEACRPAAGGAVHTRGLDFACDIYIWAPLAGTCGVLLLSLVITLYCKRGRKK

SEQ ID NO: 12140 - protein, 643 aa, Artificial Sequence
  Synthetic Polypeptide
MALPVTALLLPLALLLHAARPMMKREKNVIYGPEPLHPLEDLTAGEMLFRALRKHSHLPQALVDVVGDESLSYKEFFEATVLLAQSLHNCGYKMNDVVSICAENNTRFFIPVIAAWYIGMIVAPVNESYIPDELCKVMGISKPQIVFTTKNILNKVLEVQSRTNFIKRIIILDTVENIHGCESLPNGISRYSDGNIANFKPLHFDPVEQVAAILCSSGTTGLPKGVMQTHQNICVRLIHALDPRAGTQLIPGVTVLVYLPFFHAFGFSITLGYFMVGLRVIMFRRFDQEAFLKAIQDYEVRSVINVPSVILFLSKSPLVDKYDLSSLRELCCGAAPLAKEVAEVAAKRLNLPGIRCGFGLTESTSANIHSLRDEFKSGSLGRVTPLMAAKIADRETGKALGPNQVGELCIKGPMVSKGYVNNVEATKEAIDDDGWLHSGDFGYYDEDEHFYVVDRYKELIKYKGSQVAPAELEEILLKNPCIRDVAVVGIPDLEAGELPSAFVVKQPGKEITAKEVYDYLAERVSHTKYLRGGVRFVDSIPRNVTGKITRKELLKQLLEKAGGLEAKPTTTPAPRPPTPAPTIASQPLSLRPEACRPAAGGAVHTRGLDFACDIYIWAPLAGTCGVLLLSLVITLYCKRGRKK

SEQ ID NO: 12141 - protein, 643 aa, Artificial Sequence
  Synthetic Polypeptide
MALPVTALLLPLALLLHAARPMVKREKNVIYGPEPLHPLEDLTAGEMLFRALRKHSHLPQALVDVVGDESLSYKEFFEATVLLAQSLHNCGYKMNDVVSICAENNTRFFIPVIAAWYIGMIVAPVNESYIPDELCKVMGISKPQIVFTTKNILNKVLEVQSRTNFIKRIIILDTVENIHGCESLPNFISRYSDGNIANFKPLHFDPVEQVAAILCSSGTTGLPKGVMQTHQNICVRLIHALDPRYGTQLIPGVTVLVYLPFFHAFGFHITLGYFMVGLRVIMFRRFDQEAFLKAIQDYEVRSVINVPSVILFLSKSPLVDKYDLSSLRELCCGAAPLAKEVAEVAAKRLNLPGIRCGFGLTESTSAIIQTLGDEFKSGSLGRVTPLMAAKIADRETGKALGPNQVGELCIKGPMVSKGYVNNVEATKEAIDDDGWLHSGDFGYYDEDEHFYVVDRYKELIKYKGSQVAPAELEEILLKNPCIRDVAVVGIPDLEAGELPSAFVVKQPGTEITAKEVYDYLAERVSHTKYLRGGVRFVDSIPRNVTGKITRKELLKQLLVKAGGLEAKPTTTPAPRPPTPAPTIASQPLSLRPEACRPAAGGAVHTRGLDFACDIYIWAPLAGTCGVLLLSLVITLYCKRGRKK

SEQ ID NO: 12142 - protein, 591 aa, Artificial Sequence
  Synthetic Polypeptide
MALPVTALLLPLALLLHAARPMIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGLEAKPTTTPAPRPPTPAPTIASQPLSLRPEACRPAAGGAVHTRGLDFACDIYIWAPLAGTCGVLLLSLVITLYCKRGRKK

SEQ ID NO: 12143 - protein, 337 aa, Artificial Sequence
  Synthetic Polypeptide
MALPVTALLLPLALLLHAARPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYKLEAKPTTTPAPRPPTPAPTIASQPLSLRPEACRPAAGGAVHTRGLDFACDIYIWAPLAGTCGVLLLSLVITLYCKRGRKK

SEQ ID NO: 12144 - protein, 340 aa, Artificial Sequence
  Synthetic Polypeptide
MALPVTALLLPLALLLHAARPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKLEAKPTTTPAPRPPTPAPTIASQPLSLRPEACRPAAGGAVHTRGLDFACDIYIWAPLAGTCGVLLLSLVITLYCKRGRKK

SEQ ID NO: 12145 - skipped

SEQ ID NO: 12146 - protein, 279 aa, Artificial Sequence
  Synthetic Polypeptide
MNSFSTSAFGPVAFSLGLLLVLPAAFPAPVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEAKPTTTPAPRPPTPAPTIASQPLSLRPEACRPAAGGAVHTRGLDFACDTNATTKAAGGALQSTASLFVVSLSLLHLYS

SEQ ID NO: 12147 - protein, 270 aa, Artificial Sequence
  Synthetic Polypeptide
MALPVTALLLPLALLLHAARPMKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEAKPTTTPAPRPPTPAPTIASQPLSLRPEACRPAAGGAVHTRGLDFACDTNATTKAAGGALQSTASLFVVSLSLLHLYS

SEQ ID NO: 12148 - protein, 272 aa, Artificial Sequence
  Synthetic Polypeptide
MALPVTALLLPLALLLHAARPMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEAKPTTTPAPRPPTPAPTIASQPLSLRPEACRPAAGGAVHTRGLDFACDTNATTKAAGGALQSTASLFVVSLSLLHLYS

SEQ ID NO: 12149 - protein, 249 aa, Artificial Sequence
  Synthetic Polypeptide
MALPVTALLLPLALLLHAARPMEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEAKPTTTPAPRPPTPAPTIASQPLSLRPEACRPAAGGAVHTRGLDFACDTNATTKAAGGALQSTASLFVVSLSLLHLYS

SEQ ID NO: 12150 - protein, 254 aa, Artificial Sequence
  Synthetic Polypeptide
MALPVTALLLPLALLLHAARPMNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEAKPTTTPAPRPPTPAPTIASQPLSLRPEACRPAAGGAVHTRGLDFACDTNATTKAAGGALQSTASLFVVSLSLLHLYS

SEQ ID NO: 12151 - protein, 307 aa, Artificial Sequence
  Synthetic Polypeptide
MALPVTALLLPLALLLHAARPMLPASPTDRSIVLDNGYVCSWEGIPDDLRDCPKTEDMSKQHGAALKLPPDVLDEMECNAKKSGCVRGCLQCLALIKCTAKMRKYIPGRCHSYEGDKDIAQGGIGKELTIDIPEIPGFLDLAPMDQFVAQVDLCVDCSSRCLKGLANVQCSCKLYKWLPTRCTGFQAKIKKEADTVIGLEDALALGFDTIQACVAAGKCKDTVGRYSLEAKPTTTPAPRPPTPAPTIASQPLSLRPEACRPAAGGAVHTRGLDFACDTNATTKAAGGALQSTASLFVVSLSLLHLYS

SEQ ID NO: 12152 - protein, 270 aa, Artificial Sequence
  Synthetic Polypeptide
MALPVTALLLPLALLLHAARPMAASEEADDDHVSLVKNYWRIGVGNERDVSLDRGGPPKLSKELLAEMHAIASNAGCSRVCLIGLSKIKCTPKMKTFLPGRCNTFAPKPATGDGPFAAAAAIPGFSDLTAMEQYKAQVAQCDCSNRCLVGLANIKCSAALKAALPQRCTTFATNIQKEGEVDSIKGYGRKLEAKPTTTPAPRPPTPAPTIASQPLSLRPEACRPAAGGAVHTRGLDFACDTNATTKAAGGALQSTASLFVVSLSLLHLYS

SEQ ID NO: 12153 - protein, 296 aa, Artificial Sequence
  Synthetic Polypeptide
MALPVTALLLPLALLLHAARPMQPTENKQESQIEDIDRSTSLGLMCYEQCTGQSGLDLKCYKECADFTGDRNRGRKLPGKKLPLEVLKIMEANARRAGCTRGCLICLSKIKCTAKMKQYIPGRCHTYEGDKSIGQGGIGGPIVDIPEIIGFQNMEPMEQFIAQVDLCADCTTGCLKGLANVRCNDLLKKWLPDRCAGFANKIQSEVDNIKGLAGDRLEAKPTTTPAPRPPTPAPTIASQPLSLRPEACRPAAGGAVHTRGLDFACDTNATTKAAGGALQSTASLFVVSLSLLHLYS

SEQ ID NO: 12154 - protein, 271 aa, Artificial Sequence
  Synthetic Polypeptide
MALPVTALLLPLALLLHAARPMKSIDSYENIDIVAVAGNFAAVDQDANRGGNLPGKKMPIEVLKEMEANAKRAGCVRGCLICLSHIKCTAKMKKFIPGRCHSYHGDADTKQGALEEVVDMPEIPGFVDMEPMEQFIAQVDKCEDCTTGCLKGLANVHCSDLLKKWLPQRCSQFADKIQSEVDTIKGLAGDRLEAKPTTTPAPRPPTPAPTIASQPLSLRPEACRPAAGGAVHTRGLDFACDTNATTKAAGGALQSTASLFVVSLSLLHLYS

SEQ ID NO: 12155 - protein, 294 aa, Artificial Sequence
  Synthetic Polypeptide
MALPVTALLLPLALLLHAARPMNPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDLCADCTTGCLKGLANVKCSALLKKWLPDRCASFADKIQSEVDNIKGLAGDRLEAKPTTTPAPRPPTPAPTIASQPLSLRPEACRPAAGGAVHTRGLDFACDTNATTKAAGGALQSTASLFVVSLSLLHLYS

SEQ ID NO: 12156 - protein, 271 aa, Artificial Sequence
  Synthetic Polypeptide
MALPVTALLLPLALLLHAARPMKPTENNDDIDIVGIASTFITTNTDADRGKMPGKKLPLAVLKEMEANAAKAGCSRGCLICLSKIKCTAKMKQFIPGRCHDYGGDKKTGQAALVGAIFDIPEIFGFLDMEPIEQFIAQVDLCAGCTTGCLKGLANIKCSELLKKWLPKRCTSFAYKMQKEMHNIKGMAGDRLEAKPTTTPAPRPPTPAPTIASQPLSLRPEACRPAAGGAVHTRGLDFACDTNATTKAAGGALQSTASLFVVSLSLLHLYS

SEQ ID NO: 12157 - protein, 271 aa, Artificial Sequence
  Synthetic Polypeptide
MALPVTALLLPLALLLHAARPMKATENNDDIDIVGIASTFITTNTDADRGKMPGKRLPLAVLKEMEANAVKAGCSRGCLICLSKIKCTAKMKQYIPGRCHDYGGDKKTGQAAIEGAIDDIPEISGFKEMAPMEQFIAQVDLCADCTTGCLKGLANVKCSELLKKWLPKRCTSFATKMQKEIHNIKGMGGDRLEAKPTTTPAPRPPTPAPTIASQPLSLRPEACRPAAGGAVHTRGLDFACDTNATTKAAGGALQSTASLFVVSLSLLHLYS

SEQ ID NO: 12158 - protein, 297 aa, Artificial Sequence
  Synthetic Polypeptide
MALPVTALLLPLALLLHAARPMNPTETQDGVDILGVEGKFGTETNLETDLFTIWEINGIIKSDRDTNRANADADRGKMPGKKLPLAVLIEMEANAFKAGCTRGCLICLSKIKCTAKMKEYIPGRCHDYGGDKKTGQAGIVGAIVDIPEISGFKELGPMEQFIAQVDLCADCTTGCLKGLANVKCSALLKKWLPDRCASFADKIQSEVHNIKGLAGDRLEAKPTTTPAPRPPTPAPTIASQPLSLRPEACRPAAGGAVHTRGLDFACDTNATTKAAGGALQSTASLFVVSLSLLHLYS

SEQ ID NO: 12159 - protein, 275 aa, Artificial Sequence
  Synthetic Polypeptide
MALPVTALLLPLALLLHAARPMATINENFEDIDLVAIGGSFATDVDANRGGHGGHPGKKMPKEVLLEMEANAKRAGCHRGCLICLSHIKCTQKMKKFIPGRCHSYAGDKDSAQGGITEEETVDMPEIAGFKDLEPMEQFIAQVDLCVDCTTGCLKGLANVHCSDLLKKWLPSRCKTFASKIQSQVDTIKGLAGDRLEAKPTTTPAPRPPTPAPTIASQPLSLRPEACRPAAGGAVHTRGLDFACDTNATTKAAGGALQSTASLFVVSLSLLHLYS

SEQ ID NO: 12160 - protein, 294 aa, Artificial Sequence
  Synthetic Polypeptide
MALPVTALLLPLALLLHAARPMNPTENNDHINIVGIEGKFGITDLETDLFTIWETNRMISTDNEQANTDSNRGKMPGKKLPLAVLIEMEANAFKAGCTRGCLICLSKIKCTAKMKKYIPGRCHDYGGDKKTGQAGIVGAIVDIPDISGFKEMGPMEQFIAQVDRCTDCTTGCLKGLANVKCSELLKKWLPDRCASFADKIQSEVHNIKGLAGDRLEAKPTTTPAPRPPTPAPTIASQPLSLRPEACRPAAGGAVHTRGLDFACDTNATTKAAGGALQSTASLFVVSLSLLHLYS

SEQ ID NO: 12161 - protein, 267 aa, Artificial Sequence
  Synthetic Polypeptide
MALPVTALLLPLALLLHAARPMQPTENKKESYTEDTDVNGDHDRGRKLPGKKLPLEVLKIMEANARRAGCTRGCLICLSKIKCTAKMKQYIPGRCHTYEGDKSIGQAGIGGPIIDIPEIIGFKNMEPMEQFIAQVDLCADCTTGCLKGLANVRCNDLLKKWLPDRCAGFALKIQGEVENIKGMAGDRLEAKPTTTPAPRPPTPAPTIASQPLSLRPEACRPAAGGAVHTRGLDFACDTNATTKAAGGALQSTASLFVVSLSLLHLYS

SEQ ID NO: 12162 - protein, 307 aa, Artificial Sequence; identical to SEQ ID NO: 12151
  Synthetic Polypeptide

SEQ ID NO: 12163 - protein, 279 aa, Artificial Sequence
  Synthetic Polypeptide
MALPVTALLLPLALLLHAARPMWAASEEADDDLVSLVKNYWGVGVSNERDVSLDRGGHGKLPKKLSVEILAEMEANAQKSNCSRGCLIGLSKIKCTPKMKKFLPGRCHEYSGDPKTGQGPLTAAAVIPGYSDLTAMEQFKLQVDKCDCSTQCLKGLANVKCSAALKAVLPTRCSQFATQIQAEVGTIKGKGKKPTPPIGLEAKPTTTPAPRPPTPAPTIASQPLSLRPEACRPAAGGAVHTRGLDFACDTNATTKAAGGALQSTASLFVVSLSLLHLYS

SEQ ID NO: 12164 - protein, 294 aa, Artificial Sequence
  Synthetic Polypeptide
MALPVTALLLPLALLLHAARPMKPTEINEDLNIAAVASNFATTDLETDLFTNWETMNVISTDTEQVNTDADRGKLPGKKLPPDVLRELEANARRAGCTRGCLICLSHIKCTPKMKKFIPGRCHTYEGEKESAQGGIGEAIVDIPEIPGFKDKEPLDQFIAQVDLCADCTTGCLKGLANVQCSDLLKKWLPQRCTTFASKIQGRVDKIKGLAGDRLEAKPTTTPAPRPPTPAPTIASQPLSLRPEACRPAAGGAVHTRGLDFACDTNATTKAAGGALQSTASLFVVSLSLLHLYS

SEQ ID NO: 12165 - protein, 412 aa, Artificial Sequence
  Synthetic Polypeptide
MALPVTALLLPLALLLHAARPMASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQLEAKPTTTPAPRPPTPAPTIASQPLSLRPEACRPAAGGAVHTRGLDFACDTNATTKAAGGALQSTASLFVVSLSLLHLYS

SEQ ID NO: 12166 - protein, 651 aa, Artificial Sequence
  Synthetic Polypeptide
MALPVTALLLPLALLLHAARPMEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAVLEAKPTTTPAPRPPTPAPTIASQPLSLRPEACRPAAGGAVHTRGLDFACDTNATTKAAGGALQSTASLFVVSLSLLHLYS

SEQ ID NO: 12167 - protein, 645 aa, Artificial Sequence
  Synthetic Polypeptide
MALPVTALLLPLALLLHAARPMADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGLEAKPTTTPAPRPPTPAPTIASQPLSLRPEACRPAAGGAVHTRGLDFACDTNATTKAAGGALQSTASLFVVSLSLLHLYS

SEQ ID NO: 12168 - protein, 645 aa, Artificial Sequence
  Synthetic Polypeptide
MALPVTALLLPLALLLHAARPMADKNILYGPEPFYPLEDGTAGEQMFDALSRYADIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNDDLGGYQCLNNFISQNSDSNLDVKKFKPYSFNRDDQVALIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPFHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVIFLDEIPKGSTGKIDRKVLRQMLEKHTNGLEAKPTTTPAPRPPTPAPTIASQPLSLRPEACRPAAGGAVHTRGLDFACDTNATTKAAGGALQSTASLFVVSLSLLHLYS

SEQ ID NO: 12169 - protein, 645 aa, Artificial Sequence
  Synthetic Polypeptide
MALPVTALLLPLALLLHAARPMADKNILYGPEPFYPLADGTAGEQMFDALSRYADISGCIALTNAHTKENVLYEEFLKLSCRLAESFKKYGLKQNDTIAVCSENGLQFFLPVIASLYLGIIAAPVSDKYIERELIHSLGIVKPRIIFCSKNTFQKVLNVKSKLKSVETIIILDLNEDLGGYQCLNNFISQNSDSNLDVKKFKPYSFNRDDQVALVMFSSGTTGVPKGVMLTHKNIVARFSLAKDPTFGNAINPTTAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDARPGSTGKIVPFHAVKVVDPTTGKILGPNEPGELYFKGAMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDFVSSQVSTAKWLRGGVKFLDEIPKGSTGKIDRKVLRQMFEKHTNGLEAKPTTTPAPRPPTPAPTIASQPLSLRPEACRPAAGGAVHTRGLDFACDTNATTKAAGGALQSTASLFVVSLSLLHLYS

SEQ ID NO: 12170 - protein, 645 aa, Artificial Sequence
  Synthetic Polypeptide
MALPVTALLLPLALLLHAARPMADKNILYGPEPFYPLADGTAGEQMFYALSRYADISGCIALTNAHTKENVLYEEFLKLSCRLAESFKKYGLKQNDTIAVCSENGLQFFLPIIASLYLGIIAAPVSDKYIERELIHSLGIVKPRIIFCSKNTFQKVLNVKSKLKYVETIIILDLNEDLGGYQCLNNFISQNSDINLDVKKFKPYSFNRDDQVALVMFSSGTTGVSKGVMLTHKNIVARFSLAKDPTFGNAINPTTAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPNNDVRPGSTGKIVPFHAVKVVDPTTGKILGPNEPGELYFKGDMIMKGYYNNEEATKAIINKDGWLRSGDIAYYDNDGHFYIVDRLKSLIKYKGYQVAPAEIEGILLQHPYIVDAGVTGIPDEAAGELPAAGVVVQTGKYLNEQIVQNFVSSQVSTAKWLRGGVKFLDEIPKGSTGKIDRKVLRQMFEKHTNGLEAKPTTTPAPRPPTPAPTIASQPLSLRPEACRPAAGGAVHTRGLDFACDTNATTKAAGGALQSTASLFVVSLSLLHLYS

SEQ ID NO: 12171 - protein, 643 aa, Artificial Sequence
  Synthetic Polypeptide
MALPVTALLLPLALLLHAARPMMKREKNVIYGPEPLHPLEDLTAGEMLFRALRKHSHLPQALVDVVGDESLSYKEFFEATVLLAQSLHNCGYKMNDVVSICAENNTRFFIPVIAAWYIGMIVAPVNESYIPDELCKVMGISKPQIVFTTKNILNKVLEVQSRTNFIKRIIILDTVENIHGCESLPNGISRYSDGNIANFKPLHFDPVEQVAAILCSSGTTGLPKGVMQTHQNICVRLIHALDPRAGTQLIPGVTVLVYLPFFHAFGFSITLGYFMVGLRVIMFRRFDQEAFLKAIQDYEVRSVINVPSVILFLSKSPLVDKYDLSSLRELCCGAAPLAKEVAEVAAKRLNLPGIRCGFGLTESTSANIHSLRDEFKSGSLGRVTPLMAAKIADRETGKALGPNQVGELCIKGPMVSKGYVNNVEATKEAIDDDGWLHSGDFGYYDEDEHFYVVDRYKELIKYKGSQVAPAELEEILLKNPCIRDVAVVGIPDLEAGELPSAFVVKQPGKEITAKEVYDYLAERVSHTKYLRGGVRFVDSIPRNVTGKITRKELLKQLLEKAGGLEAKPTTTPAPRPPTPAPTIASQPLSLRPEACRPAAGGAVHTRGLDFACDTNATTKAAGGALQSTASLFVVSLSLLHLYS

SEQ ID NO: 12172 - protein, 643 aa, Artificial Sequence
  Synthetic Polypeptide
MALPVTALLLPLALLLHAARPMVKREKNVIYGPEPLHPLEDLTAGEMLFRALRKHSHLPQALVDVVGDESLSYKEFFEATVLLAQSLHNCGYKMNDVVSICAENNTRFFIPVIAAWYIGMIVAPVNESYIPDELCKVMGISKPQIVFTTKNILNKVLEVQSRTNFIKRIIILDTVENIHGCESLPNFISRYSDGNIANFKPLHFDPVEQVAAILCSSGTTGLPKGVMQTHQNICVRLIHALDPRYGTQLIPGVTVLVYLPFFHAFGFHITLGYFMVGLRVIMFRRFDQEAFLKAIQDYEVRSVINVPSVILFLSKSPLVDKYDLSSLRELCCGAAPLAKEVAEVAAKRLNLPGIRCGFGLTESTSAIIQTLGDEFKSGSLGRVTPLMAAKIADRETGKALGPNQVGELCIKGPMVSKGYVNNVEATKEAIDDDGWLHSGDFGYYDEDEHFYVVDRYKELIKYKGSQVAPAELEEILLKNPCIRDVAVVGIPDLEAGELPSAFVVKQPGTEITAKEVYDYLAERVSHTKYLRGGVRFVDSIPRNVTGKITRKELLKQLLVKAGGLEAKPTTTPAPRPPTPAPTIASQPLSLRPEACRPAAGGAVHTRGLDFACDTNATTKAAGGALQSTASLFVVSLSLLHLYS

SEQ ID NO: 12173 - protein, 591 aa, Artificial Sequence
  Synthetic Polypeptide
MALPVTALLLPLALLLHAARPMIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGLEAKPTTTPAPRPPTPAPTIASQPLSLRPEACRPAAGGAVHTRGLDFACDTNATTKAAGGALQSTASLFVVSLSLLHLYS

SEQ ID NO: 12174 - protein, 337 aa, Artificial Sequence
  Synthetic Polypeptide
MALPVTALLLPLALLLHAARPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYKLEAKPTTTPAPRPPTPAPTIASQPLSLRPEACRPAAGGAVHTRGLDFACDTNATTKAAGGALQSTASLFVVSLSLLHLYS

SEQ ID NO: 12175 - protein, 270 aa, Artificial Sequence; identical to SEQ ID NO: 12147
  Synthetic Polypeptide

SEQ ID NO: 12176 - skipped

SEQ ID NO: 12177 - protein, 711 aa, Artificial Sequence
  Synthetic Polypeptide
MKCLLYLAFLFIGVNCKFTIVFPHNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGKRAKRSGSGATNFSLLKQAGDVEENPGPTSMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 12178 - protein, 813 aa, Artificial Sequence
  Synthetic Polypeptide
MKCLLYLAFLFIGVNCKFTIVFPHNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGKRAKRSGSGATNFSLLKQAGDVEENPGPTSMNSFSTSAFGPVAFSLGLLLVLPAAFPAPVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEKIEVMYPPPYLDNEKSNGTIIHVKGKHLCPSPLFPGPSKPFWVLVVVGGVLACYSLLVTVAFIIFWVRSKRS

SEQ ID NO: 12179 - protein, 819 aa, Artificial Sequence
  Synthetic Polypeptide
MKCLLYLAFLFIGVNCKFTIVFPHNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGKRAKRSGSGATNFSLLKQAGDVEENPGPTSMNSFSTSAFGPVAFSLGLLLVLPAAFPAPVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEAKPTTTPAPRPPTPAPTIASQPLSLRPEACRPAAGGAVHTRGLDFACDIYIWAPLAGTCGVLLLSLVITLYCKRGRKK

SEQ ID NO: 12180-12184 - skipped (5 entries)

SEQ ID NO: 12185 - DNA, 1350 bp, Artificial Sequence
  Synthetic Polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 12186 - DNA, 1356 bp, Artificial Sequence
  Synthetic Polynucleotide
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 12187 - DNA, 1359 bp, Artificial Sequence
  Synthetic Polynucleotide
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 12188 - DNA, 1359 bp, Artificial Sequence
  Synthetic Polynucleotide
atggccttaccagtgaccgccttgctcctgccgctggccttgctgctccacgccgccaggccggaggtgcaactggttgagtctggcggaggactggtgcagcctggaagaagcctgagactgtcttgtgccgccagcggcttcaccttcgacgattatgccatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactactgcgccaaagacaaaggcggaggctactacgacttttggagcggcagcgattattggggccagggcacactggtcacagtgtctagcggcggaggcggaagtggaggcggaggatctggcggcggaggctcttcttctgagctgacacaggaccctgccgtgtctgttgctctgggccagacagtgcggattacctgtcagggcgatagcctgagaagctactacgcctcctggtatcagcagaagccaggccaggctcctgtgctggtcatctacggcaagaacaacagacccagcggcatccccgatagattcagcggaagcagctctggcaataccgccagcctgacaattactggcgctcaggccgaggacgaggccgactactactgcaacagcagagatagcagcggctgggttttcggcggaggcacaaaactgacagtgctgacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 12189 - DNA, 1365 bp, Artificial Sequence
  Synthetic Polynucleotide
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 12190 - DNA, 1356 bp, Artificial Sequence
  Synthetic Polynucleotide
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 12191 - DNA, 1347 bp, Artificial Sequence
  Synthetic Polynucleotide
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 12192 - DNA, 1356 bp, Artificial Sequence
  Synthetic Polynucleotide
atggccttaccagtgaccgccttgctcctgccgctggccttgctgctccacgccgccaggccggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 12193 - DNA, 1350 bp, Artificial Sequence
  Synthetic Polynucleotide
atggccttaccagtgaccgccttgctcctgccgctggccttgctgctccacgccgccaggccggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 12194 - DNA, 1365 bp, Artificial Sequence
  Synthetic Polynucleotide
atggccttaccagtgaccgccttgctcctgccgctggccttgctgctccacgccgccaggccggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 12195 - DNA, 1347 bp, Artificial Sequence
  Synthetic Polynucleotide
atggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 12196 - DNA, 1371 bp, Artificial Sequence
  Synthetic Polynucleotide
atggccttaccagtgaccgccttgctcctgccgctggccttgctgctccacgccgccaggccggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 12197 - DNA, 1353 bp, Artificial Sequence
  Synthetic Polynucleotide
atggccttaccagtgaccgccttgctcctgccgctggccttgctgctccacgccgccaggccggaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctggcggaggcggaagtggaggcggaggatctggcggcggaggctctgacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 12198 - DNA, 1344 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 12199 - skipped

SEQ ID NO: 12200 - protein, 450 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 12201 - protein, 452 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 12202 - protein, 453 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 12203 - protein, 453 aa, Artificial Sequence
  Synthetic Polypeptide
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 12204 - protein, 455 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 12205 - protein, 452 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 12206 - protein, 449 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 12207 - protein, 452 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 12208 - protein, 450 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 12209 - protein, 455 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 12210 - protein, 449 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 12211 - protein, 457 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 12212 - protein, 451 aa, Artificial Sequence
  Synthetic Polypeptide
MALPVTALLLPLALLLHAARPEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSGGGGSGGGGSGGGGSDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 12213 - protein, 448 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 12214 - skipped

SEQ ID NO: 12215 - DNA, 2175 bp, Artificial Sequence
  Synthetic Polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 12216 - DNA, 2604 bp, Artificial Sequence
  Synthetic Polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 12217 - DNA, 2181 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 12218 - DNA, 2058 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 12219 - DNA, 1953 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagcgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 12220 - DNA, 2568 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 12221 - DNA, 2199 bp, Artificial Sequence
  Synthetic Polynucleotide
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 12222 - DNA, 2076 bp, Artificial Sequence
  Synthetic Polynucleotide
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 12223 - DNA, 1971 bp, Artificial Sequence
  Synthetic Polynucleotide
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagcgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 12224 - DNA, 2541 bp, Artificial Sequence
  Synthetic Polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggaggcagcctcgagggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagtagagcaaagcgaagtggtagcggagcaaccaacttttctctgctcaagcaagccggtgacgtggaagagaaccctggtcctcatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 12225-12227 - skipped (3 entries)

SEQ ID NO: 12228 - protein, 724 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVEQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 12229 - protein, 867 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 12230 - protein, 726 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 12231 - protein, 685 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRIRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 12232 - protein, 650 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 12233 - protein, 855 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 12234 - protein, 732 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 12235 - protein, 656 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 12236 - protein, 656 aa, Artificial Sequence; identical to SEQ ID NO: 12235
  Synthetic Polypeptide

SEQ ID NO: 12237 - protein, 846 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVEQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGGSLEGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTSRAKRSGSGATNFSLLKQAGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA
